(12) United States Patent
Khakhar et al.

(10) Patent No.: US 12,351,811 B2
(45) Date of Patent: *Jul. 8, 2025

(54) METHOD FOR MODIFYING PLANTS WITH A RECOMBINANT RNA MOLECULE

(71) Applicant: FLAGSHIP PIONEERING INNOVATIONS VII, LLC, Cambridge, MA (US)

(72) Inventors: Arjun Devang Khakhar, Fort Collins, CO (US); Barry Andrew Martin, Newport, RI (US); Yajie Niu, Lexington, MA (US); Fu Chyun Chu, Arlington, MA (US); Elizabeth Jane Antonelli Dennis, Putnam, CT (US); Mehmet Ali Halac, Philadelphia, PA (US); Yumeng Hao, Cambridge, MA (US); James Michael Kremer, Cambridge, MA (US); Jayashree Kumar, Somerville, MA (US); Shankar Raj Pant, Arlington, MA (US); Aditya Sushil Kumar Singh, Brookline, MA (US)

(73) Assignee: FLAGSHIP PIONEERING INNOVATIONS VII, LLC, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/948,087

(22) Filed: Nov. 14, 2024

(65) Prior Publication Data
US 2025/0075227 A1  Mar. 6, 2025

Related U.S. Application Data

(63) Continuation of application No. 18/700,801, filed as application No. PCT/US2022/078963 on Oct. 31, 2022.

(60) Provisional application No. 63/379,063, filed on Oct. 11, 2022, provisional application No. 63/274,156, filed on Nov. 1, 2021.

(51) Int. Cl.
C12N 15/82 (2006.01)

(52) U.S. Cl.
CPC ..... *C12N 15/8282* (2013.01); *C12N 15/8203* (2013.01)

(58) Field of Classification Search
None
See application file for complete search history.

(56) References Cited

U.S. PATENT DOCUMENTS

| 5,304,731 A | 4/1994 | Masuta et al. |
| 5,500,360 A | 3/1996 | Ahlquist et al. |
| 8,030,473 B2 | 10/2011 | Carrington et al. |
| 11,845,942 B2 | 12/2023 | Lindbo |
| 2003/0135882 A1 | 7/2003 | Metzlaff et al. |
| 2004/0045050 A1 | 3/2004 | Rasochova et al. |
| 2005/0120414 A1 | 6/2005 | Diamond |
| 2006/0257976 A1 | 11/2006 | Makeyev et al. |
| 2006/0272051 A1 | 11/2006 | Werner et al. |
| 2016/0208276 A1 | 7/2016 | Marillonnet et al. |
| 2016/0281099 A1 | 9/2016 | Tuttle et al. |
| 2019/0290674 A1 | 9/2019 | Fujita et al. |
| 2020/0165626 A1 | 5/2020 | Carrillo-Tripp et al. |
| 2020/0199605 A1 | 6/2020 | Lindbo |
| 2021/0254085 A1 | 8/2021 | Rooijen et al. |
| 2022/0002746 A1 | 1/2022 | Simon et al. |
| 2023/0227830 A1 | 7/2023 | Hauser |
| 2024/0123049 A1 | 4/2024 | Zhang et al. |

FOREIGN PATENT DOCUMENTS

| DE | 10225066 A1 | 12/2003 |
| KR | 20160025361 A | 3/2016 |
| WO | 2021072358 A1 | 4/2021 |

OTHER PUBLICATIONS

Hu et al. Viruses (2009), 1:1325-1350.*
Jayasinghe et al. Nature Communications (2021)12:7078.*
Abrahamian et al. "Development and optimization of a pepino mosaic virus-based vector for rapid expression of heterologous proteins in plants." Applied Microbiology and Biotechnology 105 (2021): 627-645.
Dalakouras et al. "Induction of Silencing in Plants by High-Pressure Spraying of In vitro-Synthesized Small RNAs." Frontiers in Plant Science 7 (2016): 1327.
Escalante et al. "Biological and molecular interactions between bell pepper endornavirus and two tobamoviruses." Frontiers in Virology 3 (2023): 1267692.
Escalante et al. "Physiological Traits of Endornavirus-Infected and Endornavirus-Free Bell Pepper." Department of Plant Pathology and Crop Physiology, Louisiana State University Agricultural Center. Presented at the 2018 International Pepper Conference, Nov. 4-6, 2018, Fort Myers, FL. Retrieved from the Internet: <URL: https://conference.ifas.ufl.edu/pepper2018/presentations/Session4_Everglades%20C/0135_Valverde_Presentation%20cap%20conf%2018.pdf>, 29 pages.
Escalante et al. "Transcriptome analysis of two near-isogenic lines of bell pepper (Capsicum annuum) infected with bell pepper endornavirus and pepper mild mottle virus." Frontiers in Genetics 14 (2023): 1182578.
Fukuhara, Toshiyuki. "Endornaviruses: persistent dsRNA viruses with symbiotic properties in diverse eukaryotes." Virus Genes 55.2 (2019): 165-173.
International Search Report and Written Opinion in PCT/US2022/078963, mailed Feb. 15, 2023, 11 pages.

(Continued)

*Primary Examiner* — Medina A Ibrahim
(74) *Attorney, Agent, or Firm* — McKee, Voorhees & Sease, PLC

(57) ABSTRACT

Synthetic endornaviral satellite RNA molecules and satellite particles containing the same are disclosed. The synthetic endornaviral satellite RNA molecules can include coding and/or non-coding cargo sequences, and are heritable through generations of plants. Also disclosed are methods of using the endornaviral satellite RNA molecules and satellite particles containing the same to change plant phenotypes, improve plant stress resistance, and improve plant pest and pathogen resistance.

19 Claims, 16 Drawing Sheets

Specification includes a Sequence Listing.

(56) References Cited

OTHER PUBLICATIONS

Jo et al. "In silico identification of Bell pepper endornavirus from pepper transcriptomes and their phylogenetic and recombination analyses." Gene 575.2 (2016): 712-717.
Khakhar et al. "RNA Viral Vectors for Accelerating Plant Synthetic Biology." Frontiers in Plant Science 12 (2021): 668580.
Khankhum, Surasak. "Persistant RNA Viruses of Common Bean (Phaseolus vulgaris): Distribution and Interaction with the Host and Acute Plant Viruses." 2016. Louisiana State University, PhD dissertation. LSU Doctoral Dissertations. Retrieved from the Internet: <URL: https://repository.lsu.edu/gradschool_dissertations/838>, 125 pages.
Okada et al. "Bell pepper endornavirus: molecular and biological properties, and occurrence in the genus *Capsicum*." Journal of General Virology 92.11 (2011): 2664-2673.
Okada et al. "Genomic sequence of a novel endornavirus from Phaseolus vulgaris and occurrence in mixed infections with two other endornaviruses." Virus Research 257 (2018): 63-67.
Olendraite et al. "Identification of RNA Virus-Derived RdRp Sequences in Publicly Available Transcriptomic Data Sets." bioRxiv (2022): 2022-10.
Ong et al. "Novel Endorna-like viruses, including three with two open reading frames, challenge the membership criteria and taxonomy of the Endornaviridae." Virology 499 (2016): 203-211.
Otulak-Koziel et al. "Ultrastructural analysis of cells from bell pepper (Capsicum annuum) infected with bell pepper endornavirus." Frontiers in Plant Science 11 (2020): 491.
Roossinck et al. "The remarkable evolutionary history of endornaviruses." Journal of General Virology 92 (2011): 2674-2678.
Roossinck, Marilyn J. "Metagenomics of plant and fungal viruses reveals an abundance of persistent lifestyles." Frontiers in Microbiology 5 (2015): 767.
Safari et al. "Coevolution of a persistent plant virus and its pepper hosts." Molecular Plant-Microbe Interactions 31.7 (2018): 766-776.
Siegel et al. "Moieties in an RNA promoter specifically recognized by a viral RNA-dependent RNA polymerase." Proceedings of the National Academy of Sciences 95.20 (1998): 11613-11618.
Smith et al. "Assembly of trans-encapsidated recombinant viral vectors engineered from Tobacco mosaic virus and Semliki Forest virus and their evaluation as immunogens." Virology 358.2 (2007): 321-333.
Song et al. "Evolution of and horizontal gene transfer in the *Endornavirus* genus." PLoS One 8.5 (2013): e64270.
Valverde et al. "ICTV virus taxonomy profile: Endornaviridae." Journal of General Virology 100.8 (2019): 1204-1205.
Abrahamian et al. "Development and optimization of a pepino mosaic virus-based vector for rapid expression of heterologous proteins in plants." Applied Microbiology and Biotechnology 105: 627-645 (2021).
Fukuhara, Toshiyuki. "Endornaviruses: persistent dsRNA viruses with symbiotic properties in diverse eukaryotes." Virus Genes 55.2: 165-173 (2019).
Jo et al. "In silico identification of Bell pepper endornavirus from pepper transcriptomes and their phylogenetic and recombination analyses." Gene 575.2: 712-717 (2016).
Communication Pursuant to Article 94(3) EPC in EP22814269.1, mailed May 14, 2025, 4 pages.

\* cited by examiner

METHOD FOR MODIFYING PLANTS WITH A RECOMBINANT RNA MOLECULE

CROSS REFERENCE TO RELATED APPLICATIONS

This application is a continuation of U.S. Ser. No. 18/700,801, filed Apr. 12, 2024, which is the US national phase of PCT/US22/78963, filed Oct. 31, 2022, which claims priority to provisional patent applications U.S. Ser. No. 63/274,156 filed Nov. 1, 2021, and U.S. Ser. No. 63/379,063 filed Oct. 11, 2022, each of which are incorporated herein by reference in their entireties.

SEQUENCE LISTING XML

This application contains a Sequence Listing which has been submitted electronically in XML file format and is hereby incorporated by reference in its entirety. The XML file, created on Oct. 22, 2022, is named P13754WO00.xml and is 1,015,030 bytes in size. Additional sequence listings incorporated herein by reference in their entireties include: 51484-006001_Sequence_Listing_10_29_21_ST25.txt, which is 535,414 bytes in size, created on Oct. 29, 2021, and submitted electronically in ASCII format on Nov. 1, 2021 with U.S. provisional patent application Ser. No. 63/274,156; and P13754US01.xml, which is 757,362 bytes in size, created on Oct. 10, 2022, and submitted electronically in XML format on Oct. 11, 2022 with U.S. provisional patent application Ser. No. 63/379,063.

TECHNICAL FIELD

Provided herein are modifying polynucleotides for use in a variety of applications, including agricultural applications.

BACKGROUND

There is need in the art for modifying polynucleotides for improving phenotypes and genotypes of organisms; in particular, for agricultural applications to improve plants such as crop plants.

SUMMARY

In one aspect, disclosed herein is a recombinant DNA molecule including a heterologous promoter that is functional in a cell and is operably linked to a DNA sequence encoding an RNA molecule, wherein the RNA molecule includes, in 5' to 3' order: (a) a 5' replicase recognition sequence that is capable of being recognized by an endornaviral RNA-dependent RNA polymerase (RDRP); (b) a cargo RNA sequence; and (c) a 3' replicase recognition sequence that is capable of being recognized by the endornaviral RDRP; wherein the RNA molecule optionally further includes at least one additional element selected from the group consisting of: (e) at least one RNA encoding a viral movement protein (MP); (f) at least one tRNA-like sequence; and (g) an encapsidation recognition sequence (ERS).

In some embodiments, (a) the 5' replicase recognition sequence includes at least one secondary structure provided in Table 8, 9, or 10; and/or (b) the 3' replicase recognition sequence includes at least one secondary structure provided in Table 11, 12, or 13.

In some embodiments, (a) the 5' replicase recognition sequence includes at least one of an RNA sequence encoded by SEQ ID NOs: 1-19, 372-405, 465, or 483-485, or the RNA sequence of SEQ ID NO:580; and/or (b) the 3' replicase recognition sequence includes at least one of an RNA sequence encoded by SEQ ID NOs: 20-38, 406-454, 467, or 486-488, or the RNA sequence of SEQ ID NO:581.

In some embodiments, (a) the 5' replicase recognition sequence is derived from an endornavirus; and/or (b) the 3' replicase recognition sequence is derived from an endornavirus. In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In some embodiments, the cell is a bacterial cell, a plant cell, a fungal cell, or an animal cell.

In some embodiments, the 5' replicase recognition sequence includes a 5' UTR sequence of the endornavirus. In some embodiments, the 5' replicase recognition sequence further includes a genomic sequence of the endornavirus that is natively located 3' to and adjacent to the 5' UTR sequence.

In some embodiments, the 3' replicase recognition sequence includes a 3' UTR sequence of the endornavirus. In some embodiments, the 3' replicase recognition sequence further includes a genomic sequence of the endornavirus that is natively located 5' to and adjacent to the 3' UTR sequence.

In some embodiments, the RNA molecule further includes at least one RNA sequence encoding a viral MP, and the at least one RNA sequence encoding an MP is located (a) before the cargo RNA sequence, (b) after the cargo RNA sequence, or (c) both before and after the cargo RNA sequence. In some embodiments, the at least one RNA sequence encoding an MP includes at least two RNA sequences encoding different MPs or a single RNA sequence encoding multiple copies of MPs.

In some embodiments, the recombinant DNA molecule of any one of the above embodiments further includes a discrete expression cassette including a second promoter that is functional in the cell and is operably linked to a DNA sequence encoding at least one viral movement protein, and optionally a terminator element.

In some embodiments, the RNA molecule further includes an ERS, wherein the ERS is located close to or adjacent to the 3' replicase recognition sequence, optionally wherein the 3' replicase recognition sequence includes a 3' UTR sequence of the endornavirus.

In some embodiments, the ERS includes a viral origin-of-assembly sequence (OAS). In some embodiments, the viral OAS sequence is a tobacco mosaic virus OAS (TMV-OAS).

In some embodiments, the RNA molecule further includes at least one tRNA-like sequence, and the at least one tRNA-like sequence includes a tRNA-like sequence from an *Arabidopsis* FT mRNA. In some embodiments, the RNA molecule further includes at least one tRNA-like sequence, e.g., at least one tRNA-like sequence comprising an RNA sequence encoded by a DNA sequence selected from the group consisting of SEQ ID NOs:114-161. In some embodiments, the RNA molecule further includes at least one RNA encoding a viral MP, a tRNA-like sequence from an *Arabidopsis* FT mRNA, and an encapsidation recognition sequence including TMV-OAS.

In some embodiments, the cargo RNA sequence is up to about 14 kb in length.

In some embodiments, the cargo RNA sequence includes: (a) at least one coding sequence, (b) at least one non-coding sequence, or (c) both at least one coding sequence and at least one non-coding sequence.

In some embodiments, the cargo RNA sequence includes at least one coding sequence, and the RNA molecule further includes an internal ribosome entry site (IRES) located 5' and immediately adjacent to the at least one coding sequence. In some embodiments, the cargo RNA sequence includes multiple coding sequences, and the RNA molecule further includes an IRES located 5' and immediately adjacent to each of the coding sequences.

In some embodiments, the cargo RNA sequence includes at least one non-coding sequence, and the at least one non-coding sequence is selected from the group consisting of a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; and a long noncoding RNA (lncRNA).

In some embodiments, the recombinant DNA molecule of any one of the above embodiments further includes a DNA sequence encoding at least one self-cleaving ribozyme. In some embodiments, the at least one self-cleaving ribozyme is located 5' to the 5' replicase recognition sequence or 3' to the 3' replicase recognition sequence.

In some embodiments, the recombinant DNA molecule of any one of the above embodiments further includes a DNA sequence encoding at least one ligand-responsive self-cleaving ribozyme (aptazyme). In some embodiments, the at least one ligand-responsive self-cleaving ribozyme is located 5' to the 5' replicase recognition sequence or 3' to the 3' replicase recognition sequence.

In some embodiments, the recombinant DNA molecule of any one of the above embodiments further includes an intronic sequence.

In some embodiments, the recombinant DNA molecule of any one of the above embodiments further includes at least one additional element selected from the group consisting of: (a) a discrete expression cassette including a second promoter operably linked to a DNA sequence to be transcribed, and optionally a terminator element; (b) an expression-enhancing element; (c) a DNA sequence encoding a marker; (d) a DNA aptamer; (e) a DNA sequence encoding an RNA aptamer; (f) T-DNA left and right border DNA sequences; (g) spacer DNA sequence; (h) a DNA sequence encoding a transcription factor binding site; (i) a DNA sequence encoding a localization sequence; (j) a DNA sequence encoding at least one sequence-specific recombinase recognition site; and (k) a DNA sequence encoding a transcript-stabilizing or transcript-destabilizing sequence.

In another aspect, disclosed herein is the RNA molecule produced by expressing the recombinant DNA molecule of any one of the above embodiments.

In another aspect, disclosed herein is a cell including the recombinant DNA molecule of any one of the above embodiments. In some embodiments, the cell is a prokaryotic cell or a eukaryotic cell.

In another aspect, disclosed herein is a vector for bacterially mediated plant transformation including the recombinant DNA molecule of any one of the above embodiments. In some embodiments, the bacterium that mediates the plant transformation is *Agrobacterium*, and the vector further includes T-DNAs flanking the DNA molecule encoding the recombinant RNA molecule.

In another aspect, disclosed herein is the vector of the above aspect, contained within a plant cell.

In another aspect, disclosed herein is an expression system including: (a) a recombinant DNA molecule including a heterologous promoter that is functional in a cell and is operably linked to a DNA sequence encoding an RNA molecule including, in 5' to 3' order: (i) a 5' replicase recognition sequence that is capable of being recognized by an endornaviral RDRP; (ii) a cargo RNA sequence; and (iii) a 3' replicase recognition sequence that is capable of being recognized by the endornaviral RDRP; and, optionally, further including at least one additional element selected from the group consisting of: (iv) at least one RNA encoding a viral movement protein (MP); (v) at least one tRNA-like sequence; and (vi) an encapsidation recognition sequence; and (b) a cell containing an RDRP protein that recognizes 5' and 3' replicase recognition sequences derived from an endornavirus.

In some embodiments, (i) the 5' replicase recognition sequence includes at least one secondary structure provided in Table 8, 9, or 10; and/or (ii) the 3' replicase recognition sequence includes at least one secondary structure provided in Table 11, 12, or 13.

In some embodiments, (i) the 5' replicase recognition sequence includes at least one of an RNA sequence encoded by SEQ ID NOs: 1-19, 372-405, 465, or 483-485, or the RNA sequence of SEQ ID NO:580; and/or (ii) the 3' replicase recognition sequence includes at least one of an RNA sequence encoded by SEQ ID NOs: 20-38, 406-454, 467, or 486-488, or the RNA sequence of SEQ ID NO:581.

In some embodiments, (i) the 5' replicase recognition sequence is derived from an endornavirus; and/or (ii) the 3' replicase recognition sequence is derived from an endornavirus. In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In some embodiments, the cell is a bacterial cell, a plant cell, a fungal cell, or an animal cell.

In some embodiments, the expression system further includes a viral coat protein that is recognized by the encapsidation recognition sequence and encapsidates the RNA molecule. In some embodiments, the viral coat protein is: (a) expressed by the recombinant DNA molecule in the cell, (b) co-expressed by a second recombinant DNA molecule in the cell; (c) provided exogenously to the cell; or (d) expressed by a virus in the cell.

In some embodiments, the RDRP protein is heterologous to the cell. In some embodiments, the RDRP protein is provided exogenously to the cell.

In some embodiments, the cell is a plant cell.

In some embodiments, the RDRP protein that recognizes the 5' and 3' replicase recognition sequences is endogenously expressed in the plant cell by the endornavirus.

In some embodiments, the endornavirus occurs naturally in the plant cell.

In some embodiments, the recombinant DNA molecule further includes at least one RNA encoding a viral MP, a tRNA-like sequence from an *Arabidopsis* FT mRNA, and an encapsidation recognition sequence including TMV-OAS.

In another aspect, disclosed herein is an agricultural formulation including the expression system of the above aspect.

In another aspect, disclosed herein is a recombinant RNA molecule including, in 5' to 3' order: (a) a 5' replicase recognition sequence that is capable of being recognized by an endornaviral RDRP; (b) a cargo RNA sequence; and (c) a 3' replicase recognition sequence that is capable of being recognized by the endornaviral RDRP; and, optionally, that further includes at least one additional element selected from the group consisting of: (d) at least one RNA encoding a viral movement protein ("MP"); (e) at least one tRNA-like sequence; and (f) an origin-of-assembly sequence ("OAS").

In some embodiments, (a) the 5' replicase recognition sequence includes at least one secondary structure provided in Table 8, 9, or 10; and/or (b) the 3' replicase recognition sequence includes at least one secondary structure provided in Table 11, 12, or 13.

In some embodiments, (a) the 5' replicase recognition sequence includes at least one RNA sequence encoded by SEQ ID NOs: 1-19, 372-405, 465, or 483-485, or the RNA sequence of SEQ ID NO:580; and/or (b) the 3' replicase recognition sequence includes at least one of RNA sequence encoded by SEQ ID NOs: 20-38, 406-454, 467, or 486-488, or the RNA sequence of SEQ ID NO:581.

In some embodiments, (a) the 5' replicase recognition sequence is derived from an endornavirus; and/or (b) the 3' replicase recognition sequence is derived from an endornavirus. In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In some embodiments, the recombinant RNA molecule is encapsidated by a viral coat protein.

In another aspect, disclosed herein is an agricultural formulation including the recombinant RNA molecule of the above aspect. In some embodiments, the recombinant RNA molecule is encapsidated by a viral coat protein.

In another aspect, disclosed herein is a cell including the recombinant RNA molecule of the above aspect.

In another aspect, disclosed herein is a method of providing a synthetic endornaviral satellite RNA to a plant cell including providing to a plant cell a recombinant RNA molecule (e.g., a synthetic endornaviral satellite RNA) including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant cell includes an RDRP protein that recognizes the 5' replicase recognition sequence and 3' replicase recognition sequence, whereby the RDRP protein catalyzes synthesis of further copies of the synthetic endornaviral satellite RNA from the recombinant RNA molecule.

In some embodiments, (a) the 5' replicase recognition sequence includes at least one secondary structure provided in Table 8, 9, or 10; and/or (b) the 3' replicase recognition sequence includes at least one secondary structure provided in Table 11, 12, or 13.

In some embodiments, (a) the 5' replicase recognition sequence includes at least one of an RNA sequence encoded by SEQ ID NOs: 1-19, 372-405, 465, or 483-485, or the RNA sequence of SEQ ID NO:580; and/or (b) the 3' replicase recognition sequence includes at least one of an RNA sequence encoded by SEQ ID NOs: 20-38, 406-454, 467, or 486-488, or the RNA sequence of SEQ ID NO:581.

In some embodiments, (a) the 5' replicase recognition sequence is derived from an endornavirus; and/or (b) the 3' replicase recognition sequence is derived from an endornavirus. In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In some embodiments, the plant cell includes the endornavirus, and the RDRP protein is provided to the plant cell by the endornavirus.

In some embodiments, the endornavirus is endemic to the plant cell.

In some embodiments, the endornavirus is exogenously provided to the plant cell; in embodiments, the exogenously provided endornavirus is endemic or native to a different plant species, variety, or germplasm, and is capable of self-replication in the plant cell.

In some embodiments, the RDRP protein is exogenously provided to the plant cell, e.g., by transgenic expression of the RDRP protein in the plant cell. In embodiments, the RDRP protein is exogenously provided to the plant cell by introducing into the plant cell an exogenous endornavirus, e.g., an endornavirus that is natively found in a different organism, species, variety, or germplasm, and that is capable of self-replication when introduced into the plant cell.

In some embodiments, the recombinant RNA molecule has been produced in a fermentation system.

In some embodiments, the synthetic endornaviral satellite RNA is provided to the plant cell by transcribing in the plant cell a recombinant DNA construct including a promoter functional in the plant cell and operably linked to a DNA sequence encoding the recombinant RNA molecule.

In some embodiments, the recombinant RNA molecule further includes an encapsidation recognition sequence, and the plant cell further includes a viral coat protein capable of encapsidating the synthetic endornaviral satellite RNA. In some embodiments, the viral coat protein is exogenously provided to the plant cell.

In some embodiments, the recombinant DNA construct further includes a DNA sequence encoding a viral coat protein.

In some embodiments, the recombinant DNA construct further includes a second promoter functional in the plant cell and operably linked to the DNA sequence encoding the viral plant protein.

In some embodiments, the viral coat protein is expressed in the plant cell and encapsidates the synthetic endornaviral satellite RNA.

In some embodiments, the plant cell includes the endornavirus, and the endornavirus provides the plant cell the RDRP protein.

In another aspect, disclosed herein is a method of obtaining a phenotypic change in a plant or plant cell including providing to a plant or plant cell a recombinant RNA molecule (e.g., a synthetic endornaviral satellite RNA) including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the cargo RNA sequence includes RNA that effects a phenotypic change in the plant or plant cell; wherein the plant or plant cell includes an RDRP protein that recognizes the 5' replicase recognition sequence and 3' replicase recognition sequence, whereby the RDRP protein catalyzes synthesis of further copies of the synthetic endornaviral satellite RNA from the recombinant RNA molecule and the cargo RNA sequence effects the phenotypic change.

In some embodiments, (a) the 5' replicase recognition sequence includes at least one secondary structure provided in Table 8, 9, or 10; and/or (b) the 3' replicase recognition sequence includes at least one secondary structure provided in Table 11, 12, or 13.

In some embodiments, (a) the 5' replicase recognition sequence includes at least one of an RNA sequence encoded by SEQ ID Nos: 1-19, 372-405, 465, or 483-485, or the RNA sequence of SEQ ID NO:580; and/or (b) the 3' replicase recognition sequence includes at least one of an RNA sequence encoded by SEQ ID NOs: 20-38, 406-454, 467, or 486-488, or the RNA sequence of SEQ ID NO:581.

In some embodiments, (a) the 5' replicase recognition sequence is derived from an endornavirus; and/or (b) the 3' replicase recognition sequence is derived from an endornavirus.

In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In some embodiments, the RNA that effects a phenotypic change in the plant or plant cell includes an RNA for modulating a target gene's expression relative to the target gene's expression in a control plant or plant cell not provided with the recombinant RNA molecule, and the phenotypic change is a result of the modulation. In some embodiments, the modulation is (a) an increase of the target gene's expression; or (b) a decrease of the target gene's expression. In some embodiments, the RNA that effects a phenotypic change in the plant or plant cell suppresses the target gene's expression.

In some embodiments, the RNA that effects a phenotypic change in the plant or plant cell includes at least one RNA selected from an siRNA or siRNA precursor, a miRNA or miRNA precursor, and a phased siRNA or phased siRNA precursor.

In some embodiments, the RNA that effects a phenotypic change in the plant or plant cell includes a messenger RNA. In some embodiments, the messenger RNA includes an RNA sequence absent in the genome of the plant or plant cell.

In some embodiments, the RNA that effects a phenotypic change in the plant or plant cell includes an RNA for modifying the genome of the plant or plant cell.

In some embodiments, the plant cell includes the endornavirus, and the RDRP protein is provided to the plant cell by the endornavirus.

In some embodiments, the endornavirus is endemic to the plant cell.

In some embodiments, the endornavirus is exogenously provided to the plant cell; in embodiments, the exogenously provided endornavirus is endemic or native to a different plant species, variety, or germplasm, and is capable of self-replication in the plant cell.

In some embodiments, the RDRP protein is exogenously provided to the plant cell, e.g., by transgenic expression of the RDRP protein in the plant cell. In embodiments, the RDRP protein is exogenously provided to the plant cell by introducing into the plant cell an exogenous endornavirus, e.g., an endornavirus that is natively found in a different organism, species, variety, or germplasm, and that is capable of self-replication when introduced into the plant cell.

In some embodiments, the recombinant RNA molecule has been produced in a fermentation system.

In some embodiments, the recombinant RNA molecule is provided to the plant cell by transcribing in the plant cell a recombinant DNA construct including a promoter functional in the plant cell and operably linked to a DNA sequence encoding the recombinant RNA molecule.

In some embodiments, the recombinant RNA molecule further includes an encapsidation recognition sequence, and the plant cell further includes a viral coat protein capable of encapsidating the synthetic endornaviral satellite RNA.

In some embodiments, the viral coat protein is exogenously provided to the plant cell.

In some embodiments, the recombinant DNA construct further includes a DNA sequence encoding a viral coat protein.

In some embodiments, the recombinant DNA construct further includes a second promoter functional in the plant cell and operably linked to the DNA sequence encoding the viral plant protein.

In some embodiments, the viral coat protein is expressed in the plant cell and encapsidates the synthetic endornaviral satellite RNA.

In some embodiments, the plant cell includes the endornavirus, and the endornavirus provides the plant cell the RDRP protein.

In some embodiments, the recombinant RNA molecule is provided to the plant cell by contacting the plant cell with a formulation including the recombinant RNA molecule, wherein the recombinant RNA molecule has been produced in a fermentation system, wherein the recombinant RNA molecule is optionally encapsidated by a viral coat protein.

In another aspect, disclosed herein is a method of increasing a plant's resistance and/or tolerance to a pest or pathogen, including: providing a plant with a recombinant RNA molecule (e.g., a synthetic endornaviral satellite RNA) including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the cargo RNA sequence effects an increase in the plant's resistance and/or tolerance to a pest or pathogen, relative to that in a plant not provided with the recombinant RNA molecule, wherein the plant or plant cell includes an RDRP protein that recognizes the 5' replicase recognition sequence and 3' replicase recognition sequence, whereby the RDRP protein catalyzes synthesis of further copies of the synthetic endornaviral satellite RNA from the recombinant RNA molecule.

In some embodiments, the pest or pathogen is selected from the group including: a bacterium, a fungus, an oomycete, and an invertebrate.

In another aspect, disclosed herein is a method of increasing a plant's resistance to stress, including: providing a plant with a recombinant RNA molecule including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant or plant cell includes an RDRP protein that recognizes the 5' replicase recognition sequence and 3' replicase recognition sequence, whereby the RDRP protein catalyzes synthesis of further copies of the synthetic endornaviral satellite RNA from the recombinant RNA molecule and wherein the cargo RNA sequence effects an increase in the plant's resistance to stress, relative to that in a plant not provided with the recombinant RNA molecule.

In some embodiments, the stress includes at least one abiotic stress selected from the group including: nutrient stress, light stress, water stress, heat stress, and cold stress. In some embodiments, the stress includes at least one biotic stress selected from the group including: crowding, shading, and allelopathy.

In another aspect, disclosed herein is a method of expressing an exogenous polypeptide in a plant or plant cell, including: expressing in a plant or plant cell a recombinant DNA molecule including a heterologous promoter that is functional in the plant or plant cell and is operably linked to a DNA sequence encoding an RNA molecule (e.g., a synthetic endornaviral satellite RNA) that includes, in 5' to 3' order: (a) a 5' replicase recognition sequence that is capable of being recognized by an endornaviral RDRP; (b) a cargo RNA sequence including a translatable messenger RNA encoding an exogenous polypeptide; and (c) a 3' replicase recognition sequence that is capable of being recognized by the endornaviral RDRP; wherein the RNA molecule optionally further includes at least one additional element selected from the group consisting of: (d) at least one RNA encoding a viral movement protein ("MP"); (e) at least one tRNA-like sequence; and (f) an encapsidation recognition sequence, wherein the plant or plant cell includes an RDRP protein that recognizes the 5' replicase recognition sequence and 3' replicase recognition sequence, whereby the RDRP protein catalyzes synthesis of further copies of a synthetic endornaviral satellite RNA from the recombinant RNA molecule and wherein the exogenous polypeptide is translated from the translatable messenger RNA encoding an exogenous polypeptide.

In some embodiments, (a) the 5' replicase recognition sequence includes at least one secondary structure provided in Table 8, 9, or 10; and/or (b) the 3' replicase recognition sequence includes at least one secondary structure provided in Table 11, 12, or 13.

In some embodiments, (a) the 5' replicase recognition sequence includes at least one of an RNA sequence encoded by SEQ ID Nos: 1-19, 372-405, 465, 483-485; and/or (b) the 3' replicase recognition sequence includes at least one of an RNA sequence encoded by SEQ ID Nos: 20-38, 406-454, 467, 486-488.

In some embodiments, (a) the 5' replicase recognition sequence is derived from an endornavirus; and/or (b) the 3' replicase recognition sequence is derived from an endornavirus. In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In another aspect, disclosed herein is a method of manufacturing a synthetic endornaviral satellite particle, including: (a) providing to a plant cell a recombinant RNA molecule including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant cell includes an RDRP protein that recognizes the 5' replicase recognition sequence and 3' replicase recognition sequence, whereby the RDRP protein catalyzes synthesis of a synthetic endornaviral satellite RNA from the recombinant RNA molecule; and (b) encapsidating the synthetic endornaviral satellite RNA with a viral coat protein, thereby providing a synthetic endornaviral satellite particle.

In some embodiments, the viral coat protein is exogenously provided to the plant cell.

In some embodiments, the plant cell further includes the viral coat protein.

In some embodiments, the viral coat protein is recombinantly expressed in the plant cell.

In some embodiments, the cargo RNA sequence is up to about 14 kb in length.

In some embodiments, the cargo RNA sequence includes: (a) at least one coding sequence, (b) at least one non-coding sequence, or (c) both at least one coding sequence and at least one non-coding sequence.

In some embodiments, the cargo RNA sequence includes at least one coding sequence, and the RNA molecule further includes an IRES located 5' and immediately adjacent to the at least one coding sequence.

In some embodiments, the cargo RNA sequence includes multiple coding sequences, and the RNA molecule further includes an IRES located 5' and immediately adjacent to each of the coding sequences.

In some embodiments, the cargo RNA sequence includes at least one non-coding sequence, and the at least one non-coding sequence is selected from the group consisting of a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; and a long noncoding RNA (lncRNA).

In some embodiments, the recombinant RNA molecule is provided to the plant cell by transcribing in the plant cell a recombinant DNA construct including a promoter functional in the plant cell and operably linked to a DNA sequence encoding the recombinant RNA molecule.

In some embodiments, the recombinant DNA construct further includes a DNA sequence encoding the viral coat protein.

In some embodiments, the recombinant DNA construct further includes a second promoter functional in the plant cell and operably linked to the DNA sequence encoding the viral plant protein.

In some embodiments, the plant cell includes the endornavirus, and the endornavirus provides the plant cell the RDRP protein.

In some embodiments, the endornavirus is endemic to the plant cell.

In some embodiments, the endornavirus is exogenously provided to the plant cell; in embodiments, the exogenously provided endornavirus is endemic or native to a different plant species, variety, or germplasm, and is capable of self-replication in the plant cell.

In some embodiments, the RDRP protein is exogenously provided to the plant cell, e.g., by transgenic expression of the RDRP protein in the plant cell. In embodiments, the RDRP protein is exogenously provided to the plant cell by introducing into the plant cell an exogenous endornavirus, e.g., an endornavirus that is natively found in a different organism, species, variety, or germplasm, and that is capable of self-replication when introduced into the plant cell.

In some embodiments, the method further includes the step of isolating the synthetic endornaviral satellite particle.

In some embodiments, the method further includes the step of purifying the synthetic endornaviral satellite particle.

In some embodiments, the method further includes the step of formulating the synthetic endornaviral satellite particle.

In another aspect, disclosed herein is the synthetic endornaviral satellite particle provided by the methods provided above.

In another aspect, disclosed herein is an agricultural formulation including the synthetic endornaviral satellite particle provided by the methods provided above.

In another aspect, disclosed herein is a method of providing a synthetic endornaviral satellite particle to a plant, including contacting the plant with the synthetic endornaviral satellite particle of the above aspects.

In some embodiments, contacting includes spraying, dusting, injecting, or soaking.

In some embodiments, the cargo RNA sequence includes at least one coding sequence encoding a polypeptide and is translated to produce the polypeptide in the plant.

In another aspect, disclosed herein is a cell-free expression system including: (a) an RNA molecule including, in 5' to 3' order: (i) a 5' replicase recognition sequence derived from an endornavirus; (ii) a cargo RNA sequence; and (iii) a 3' replicase recognition sequence derived from the endornavirus; and, optionally, further including at least one additional element selected from the group consisting of (iv) at least one RNA encoding a viral movement protein ("MP"); (v) at least one tRNA-like sequence; and (vi) an origin-of-assembly sequence ("OAS"); and (b) an RDRP protein that recognizes the 5' and 3' replicase recognition sequences from an endornavirus.

In some embodiments, (a) the 5' replicase recognition sequence includes at least one secondary structure provided in Table 8, 9, or 10; and/or (b) the 3' replicase recognition sequence includes at least one secondary structure provided in Table 11, 12, or 13.

In some embodiments, (a) the 5' replicase recognition sequence includes at least one of an RNA sequence encoded by SEQ ID Nos: 1-19, 372-405, 465, 483-485, or the RNA sequence of SEQ ID NO:580; and/or (b) the 3' replicase recognition sequence includes at least one of an RNA sequence encoded by SEQ ID Nos: 20-38, 406-454, 467, 486-488, or the RNA sequence of SEQ ID NO:581.

In some embodiments, (a) the 5' replicase recognition sequence is derived from an endornavirus; and/or (b) the 3' replicase recognition sequence is derived from an endornavirus. In some embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

In some embodiments, the RDRP protein is provided by the endornavirus.

In another aspect, disclosed herein is an agricultural formulation including the expression system of the above aspect.

In another aspect, disclosed herein is a plant or plant cell including the recombinant RNA molecule of the above aspects and an endornaviral RDRP.

In another aspect, disclosed herein is a plant propagule including the recombinant RNA molecule of the above aspects and an endornaviral RDRP.

In another aspect, disclosed herein is a method of producing a modified plant propagule that comprises at least one plant cell comprising a recombinant RNA molecule that includes isolating a plant propagule comprising at least one plant cell comprising a recombinant RNA molecule and an endornaviral RNA-dependent RNA polymerase (RDRP) from a mixed population of plant cells comprising both plant cells comprising the recombinant RNA molecule and plant cells lacking the recombinant RNA molecule, wherein the recombinant RNA molecule comprises, in 5' to 3' order, a 5' replicase recognition sequence that is capable of being recognized by the endornaviral RDRP; a cargo RNA sequence; and a 3' replicase recognition sequence that is capable of being recognized by the endornaviral RDRP.

In another aspect, disclosed herein is a method of providing a synthetic endornaviral satellite RNA to a plant that includes grafting a scion onto a rootstock comprising a recombinant RNA molecule comprising, in 5' to 3' order, a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP, and wherein at least one cell of the rootstock and/or the scion comprises the endornaviral RDRP.

In another aspect, disclosed herein is a method of producing a grafted plant comprising a recombinant RNA molecule comprising, in 5' to 3' order, a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP, wherein the recombinant RNA molecule is provided by contacting the scion, the rootstock, or both the scion and the rootstock with a composition comprising the recombinant RNA molecule prior to grafting the scion onto the rootstock to produce the grafted plant.

In another aspect, disclosed herein is a method for producing a plant that transmits a recombinant RNA molecule to progeny plants or seed that includes isolating an $F_1$ progeny plant or seed comprising at least one cell comprising an endornaviral RNA-dependent RNA polymerase (RDRP) and the recombinant RNA molecule comprising, in 5' to 3' order, a 5' replicase recognition sequence that is capable of being recognized by the endornaviral RDRP; a cargo RNA sequence; and a 3' replicase recognition sequence that is capable of being recognized by the endornaviral RDRP from a population of $F_1$ plants or seed obtained from at least one parent plant comprising the recombinant RNA molecule.

Related aspects thus include progeny plants or seeds of $F_1$, $F_2$, or later generations, that include at least the recombinant RNA molecule, or that include both the recombinant RNA molecule and the endornaviral RDRP (or endornavirus that produces the endornaviral RDRP); in certain embodiments that are particularly advantageous for at least regulatory reasons, such progeny plants or seeds lack DNA that encodes the recombinant RNA molecule.

In another aspect, disclosed herein is a method of barcoding a plant, plant cell, progeny thereof, or part thereof that includes providing to the plant or plant cell the recombinant RNA molecule of the above aspects, wherein the cargo RNA of the recombinant RNA molecule comprises a barcode RNA molecule, and wherein the plant or plant cell comprises an endornaviral RNA-dependent RNA polymerase (RDRP) protein that recognizes the 5' replicase recognition sequence and 3' replicase recognition sequence of the recombinant RNA molecule. In certain embodiments that are particularly advantageous for at least regulatory reasons, the plant, plant cell, progeny thereof, or part thereof, lack DNA that encodes the recombinant DNA molecule and lack DNA encoding the barcode RNA.

In another aspect, disclosed herein is a method of identifying a barcoded plant, plant part, or plant cell that includes screening for the presence of a barcode RNA molecule in the plant, plant part, or plant cell, wherein the plant, plant part, or plant cell comprises the recombinant RNA molecule of the above aspects, wherein the cargo RNA of the recombinant RNA molecule comprises the barcode RNA molecule.

Other features and advantages of the disclosure will be apparent from the following Detailed Description and the Claims.

Definitions

As used herein, the terms "$F_1$", (first progeny generation) "$F_2$", (second progeny generation) and the like refer to plants or seed obtained from a parent plant which has been selfed (self-pollinated) or that has been crossed to (cross-pollinated with) another plant.

As used herein, the term "heterologous", when used to describe a first element in reference to a second element means that the first element and second element do not exist in nature disposed as described. For example, a heterologous nucleic acid molecule or sequence is a nucleic acid molecule or sequence that (a) is not native to a cell in which it is expressed, (b) is linked or fused to a nucleic acid molecule or sequence with which it is not linked to or fused to in nature, or with which it is not linked to or fused to in nature in the same way, (c) has been altered or mutated by the hand of man relative to its native state, or (d) has altered expression as compared to its native expression levels under similar conditions. For example, a "heterologous promoter" is used to drive transcription of a sequence that is not one that is natively transcribed by that promoter (e.g., a eukaryote promoter used to drive transcription of a DNA molecule encoding an endornaviral RNA sequence); thus, a "heterologous promoter" sequence is often included in an expression construct by means of recombinant nucleic acid techniques. In other examples, a recombinant polynucleotide such as those provided by this disclosure can include genetic sequences of two or more different endornaviruses, which genetic sequences are "heterologous" in that they would not naturally occur together. In some embodiments "heterologous" refers to a molecule or to a discrete part of a molecule; for example, referring to a cargo RNA or payload (e.g., a nucleic acid such as a protein-encoding RNA, an ssRNA, a regulatory RNA, an interfering RNA, or a guide RNA), which can be part of a larger molecule, or referring to a structure (e.g., a plasmid or a gene-editing system) that is not found naturally in a plant endornavirus.

As used herein, the term "internal ribosome entry site" or "IRES" refers to a sequence (e.g., an RNA sequence) capable of recruiting a ribosome and translation machinery to initiate translation from an RNA sequence. An IRES element is generally between 100-800 nucleotides. An appropriate IRES can be obtained from plant and plant viral IRES sequences such as encephalomyocarditis virus IRES (ECMV), maize hsp101 IRES 5'UTR, crucifer infecting tobamovirus crTMV CR-CP 148 IRES, tobacco etch virus (TEV) IRES 5'UTR and hibiscus chlorotic ringspot virus (HCRSV) IRES. In addition, in embodiments, an IRES sequence is derived from non-plant eukaryotic virus sequences that include but are not limited to: acute bee paralysis virus (ABPV), classical swine fever virus (CSFV), coxsackievirus B3 virus (CVB3), encephalomyocarditis virus (ECMV), enterovirus 71 (E71), hepatitis A virus (HAV), human rhinovirus (HRV2), human rhinovirus (HRV2), human lymphotropic virus (HTLV), polyoma virus (PV), and *Zea mays* (ZmHSP101). Examples of IRES sequence useful in the compositions and methods described herein are shown in Table 5.

As used herein the term "percent identity" refers to percent (%) sequence identity with respect to a reference polynucleotide or polypeptide sequence following alignment by standard techniques.

Alignment for purposes of determining percent nucleic acid or amino acid sequence identity can be achieved in various ways that are within the capabilities of one of skill in the art, for example, using publicly available computer software such as BLAST, BLAST-2, PSI-BLAST, or Megalign software. In some embodiments, the software is MUSCLE (Edgar, *Nucleic Acids Res.*, 32(5): 1792-1797, 2004).

Those skilled in the art can determine appropriate parameters for aligning sequences, including any algorithms needed to achieve maximal alignment over the full length of the sequences being compared.

For example, in embodiments, percent sequence identity values are generated using the sequence comparison computer program BLAST (Altschul et al. (1990) J. Mol. Biol., 215:403-410). As an illustration, the percent sequence identity of a given nucleic acid or amino acid sequence, A, to, with, or against a given nucleic acid or amino acid sequence, B, (which can alternatively be phrased as a given nucleic acid or amino acid sequence, A that has a certain percent sequence identity to, with, or against a given nucleic acid or amino acid sequence, B) is calculated as follows:

100 multiplied by (the fraction $X/Y$)

where X is the number of nucleotides or amino acids scored as identical matches by a sequence alignment program (e.g., BLAST) in that program's alignment of A and B, and where Y is the total number of nucleotides or amino acids in B.

As used herein, the term "plant" refers to whole plants, plant organs, plant tissues, seeds, plant cells, seeds, and progeny of the same. Plant cells include, without limitation, cells from seeds, suspension cultures, embryos, meristematic regions, callus tissue, leaves, roots, shoots, gametophytes, sporophytes, pollen, and microspores. In embodiments, the plant or plant cell is haploid, diploid, triploid, tetraploid, pentaploid, hexaploid, or octoploid. In embodiments, a haploid plant or plant cell treated with a composition such as those described in this disclosure is further subjected to a haploid doubling treatment, resulting in a doubled-haploid plant or plant cell. Plant parts include differentiated and undifferentiated tissues including, but not limited to the following: roots, stems, shoots, leaves, pollen, seeds, fruit, harvested produce, tumor tissue, sap (e.g., xylem sap and phloem sap), and various forms of cells and culture (e.g., single cells, protoplasts, embryos, and callus tissue). A plant cell or tissue culture can be capable of regenerating a plant having the physiological and morphological characteristics of the plant from which the cell or tissue was obtained, and of regenerating a plant having substantially the same genotype as the plant. Regenerable cells in a plant cell or tissue culture can be embryos, protoplasts, meristematic cells, callus, pollen, leaves, anthers, roots, root tips, flowers, or stalks. In contrast, some plant cells are not capable of being regenerated to produce plants and are referred to herein as "non-regenerable" plant cells.

As used herein, the term "untreated" refers to an organism (e.g., a eukaryote, e.g., a plant, a fungus, an insect, or an animal) that has not been contacted with or delivered a recombinant polynucleotide described herein, including a separate organism that has not been delivered the recombinant polynucleotide, the same organism undergoing treatment assessed at a time point prior to delivery of the recombinant polynucleotide, or the same organism undergoing treatment assessed at an untreated part of the organism (that is, at an area of the organism not contacted with the recombinant polynucleotide).

BRIEF DESCRIPTION OF THE DRAWINGS

FIG. 15 shows a schematic of delivering a synthetic endornaviral satellite RNA carrying an anti-*botrytis* cargo RNA to pepper plants.

FIG. 16 shows the effects of *Botrytis* infection on detached leaves of: (i) untreated negative control pepper plants ("WT"); (ii) detached leaves of second-generation pepper plants with systemic distribution of the endornaviral satellite RNA "Construct 1" (SEQ ID NO: 578; "COM1"); (iii) detached leaves of second-generation pepper plants with systemic distribution of the endornaviral satellite RNA "Construct 2" (SEQ ID NO: 579; "COM2"); and (iv) positive control pepper plants treated with Captan fungicide. Also shown are pepper plant leaves treated with water instead of *Botrytis*. Bottom right panel labelled "C1-y" is a detached leaf of a second-generation pepper plant with systemic distribution of the endornaviral satellite RNA "Construct 1" (SEQ ID NO: 578; "COM1") that was treated with Captan.

DETAILED DESCRIPTION

Unless defined otherwise, all technical and scientific terms used have the same meaning as commonly understood by one of ordinary skill in the art to which this disclosure belongs. Conventional methods are used for the procedures described herein, such as those provided in the art, and demonstrated in the Examples and various general references. Unless otherwise stated, nucleic acid sequences described herein are given, when read from left to right, in the 5' to 3' direction. Nucleic acid sequences can be provided as DNA or as RNA, as specified; disclosure of one necessarily defines the other, as is known to one of ordinary skill in the art. The RNA equivalents of DNA molecules provided herein are thus provided and used in certain recombinant RNAs provided herein. Furthermore, because of known codon degeneracy, different nucleic acid sequences can encode the same polypeptide sequence, and such modified nucleic acid sequences (e.g., for the purposes of codon optimization for a given species) are within the scope of the present disclosure.

The term "comprise" is intended to mean "include". Where a term is provided in the singular, it also contemplates aspects of the disclosure described by the plural of that term. The term "and/or" where used herein is to be taken as specific disclosure of each of the multiple specified features or components with or without another. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

Recombinant Polynucleotides

This disclosure provides, inter alia, recombinant polynucleotides (e.g., recombinant DNA, recombinant RNA, recombinant ssRNAs, recombinant vectors, etc.) including one or more sequences of or derived from an endornavirus; in particular, a 5' and/or 3' replicase recognition sequence that is recognized by an endornaviral RNA-dependent RNA polymerase (RDRP). This disclosure is further related to methods of making and using such recombinant polynucleotides, for example, by employing such recombinant polynucleotides to express a heterologous cargo sequence in a plant and optionally thereby modifying expression of an endogenous target sequence and/or genotype or phenotype of the plant. In embodiments, the endornavirus is a commensal endornavirus, that is, an endornavirus that is endemic or native to a given eukaryote host (such as a host plant) without causing apparent negative effects on the host (i.e., is considered non-pathogenic), is often present at a persistent but low population (i.e., low viral titer), and is often vertically transmitted to succeeding generations of the host. In embodiments, the endornavirus is transmitted through the gametes (egg cells and/or pollen or sperm cells) to progeny plants and is thus present throughout the progeny plant in its various cells and tissues; in embodiments, the endornavirus does not normally move from cell to cell within the plant, and/or is not normally transmitted horizontally (e.g., between individual plants via mechanical injury or via an insect vector). In embodiments, the endornavirus is an exogenously introduced endornavirus (i.e., not endemic or native to the host, but artificially introduced). For example, an endornavirus natively found in one *Capsicum* species, variety, or germplasm can be introduced, with or without a corresponding recombinant endornaviral satellite RNA, into a different *Capsicum* species, variety, or germplasm, or even into a different solanaceous plant. In embodiments, a complete self-replicating endornaviral satellite system is introduced into a plant or plant cells, wherein the self-replicating endornaviral satellite system comprises: (1) a recombinant endornaviral satellite RNA comprising, in 5' to 3' order: (a) a 5' replicase recognition sequence that is capable of being recognized by an endornaviral RNA-dependent RNA polymerase (RDRP); (b) a cargo RNA sequence; and (c) a 3' replicase recognition sequence that is capable of being recognized by the endornaviral RDRP; wherein the recombinant endornaviral satellite RNA optionally further includes at least one additional element selected from the group consisting of: (d) at least one RNA encoding a viral movement protein (MP); (e) at least one tRNA-like sequence (TLS); and (f) an encapsidation recognition sequence (ERS); and (2) an exogenous endornavirus (e.g., an endornavirus that is not endemic or native to the plant or plant cells) that is capable of replication in the plant or plant cells and that encodes the endornaviral RDRP that recognizes the 5' and 3' replicase recognition sequences in the recombinant endornaviral satellite RNA. In some embodiments, the RNA molecule includes a tRNA-like sequence (TLS) comprising an RNA sequence encoded by a DNA sequence selected from the group consisting of SEQ Id NOs: 114-161. In some embodiments, the RNA molecule includes a modified tRNA-like sequence that has at least 90%, 95%, 98%, or 99% sequence identity to a scaffold tRNA-like sequence comprising an RNA sequence encoded by a DNA sequence selected from the group consisting of SEQ Id NOs: 114-161 and that maintains the secondary structure of the scaffold tRNA-like sequence.

DNA Molecules

Figure 1:
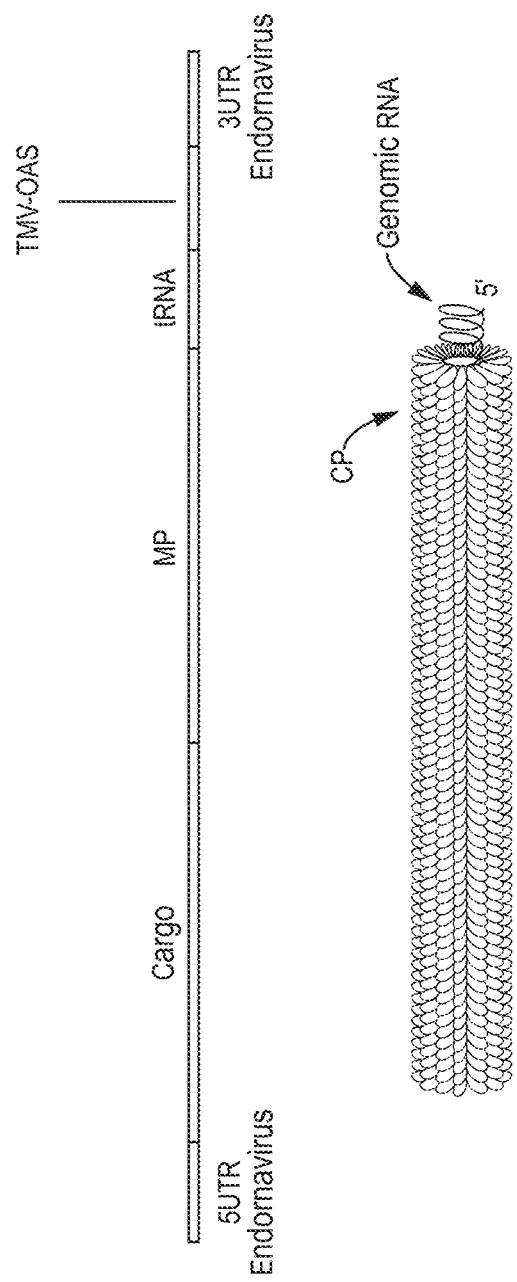
FIG. 1 shows a non-limiting embodiment of a structure of an endornaviral satellite construct.
Figure 2:
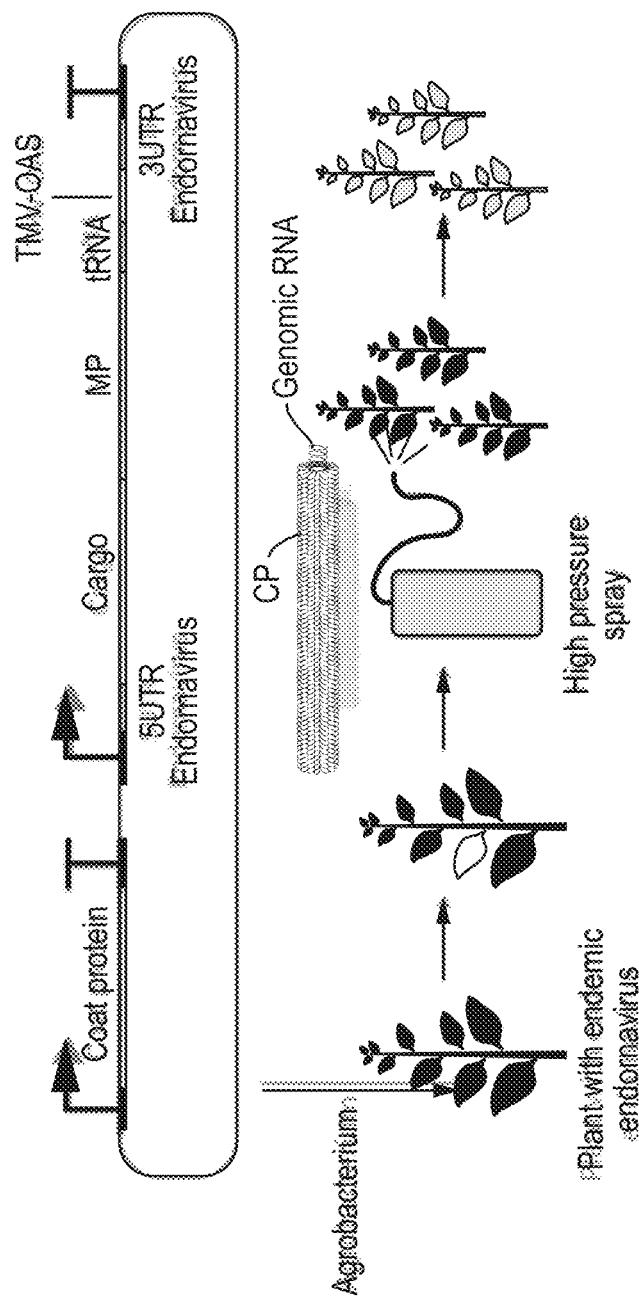
FIG. 2 shows a schematic of using *Agrobacterium* infiltration to generate a synthetic endornaviral satellite RNA, isolation of the encapsidated synthetic endornaviral satellite RNA, and field application of the encapsidated synthetic endornaviral satellite RNA to plants.

In one aspect, this disclosure is related to a recombinant DNA molecule that includes a heterologous promoter that is functional in a cell and is operably linked to a DNA sequence encoding an RNA molecule. The RNA molecule includes, in 5' to 3' order: (a) a 5' replicase recognition sequence that is capable of being recognized by an endornaviral RNA-dependent RNA polymerase (RDRP); (b) a cargo RNA sequence; and (c) a 3' replicase recognition sequence that is capable of being recognized by the endornaviral RDRP. FIG. 1 shows an embodiment of a generalized structure of a DNA polynucleotide encoding a synthetic endornaviral satellite RNA. Exemplary DNA polynucleotides (Constructs 1-11) are described in Table 7 and Examples 1-14.

The expressed RNA molecule, or "endornaviral satellite" RNA, includes, in 5' to 3' order: a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP.

The expressed RNA molecule optionally further includes at least one additional element selected from the group consisting of: (d) at least one RNA encoding a viral movement protein (MP); (e) at least one tRNA-like sequence; and (f) an encapsidation recognition sequence (ERS).

The aforementioned elements as well as additional elements useful in building modifying molecules such as DNA, RNA, and polynucleotides will now be described.

Promoters

As mentioned above, an aspect of this disclosure is related to a recombinant DNA molecule which includes a promoter that is functional in a cell (e.g., a bacterial cell, a plant cell, a fungal cell, or an animal cell) and is operably linked to a DNA sequence encoding an RNA molecule. By "operably linked" is meant that a polynucleotide and a regulatory sequence(s) are connected in such a way as to permit gene expression when the appropriate molecules (e.g., polymerases) are bound to the regulatory sequence(s).

By "regulatory element" is meant a genetic element that controls some aspect of the expression of a polynucleotide. For example, a promoter is a regulatory element that facilitates the initiation of transcription of an operably linked polynucleotide sequence (e.g., a cargo RNA sequence) such as a coding or a non-coding region. Other regulatory elements include those described herein.

For example, transcriptional regulatory elements in eukaryotes include promoter and optionally other regulatory elements. Promoters and other regulatory elements include arrays of sequences that interact directly or indirectly with cellular proteins involved in transcription. Promoter and associated elements have been isolated, without limitation, from a variety of eukaryotic, prokaryotic, and viral sources including genes in mammalian, animal, insect, fungal, and bacterial cells and those viruses described herein.

In embodiments, a promoter functional in a plant cell renders promoter-dependent gene expression controllable for cell-, tissue-, or organ-specific gene expression, or elements that are inducible by external signals or agents (for example, light-, pathogen-, wound-, stress-, or hormone-inducible elements, or chemical inducers) or elements that are capable of cycling gene transcription; such elements can be located in the 5' or 3' regions of the native gene or engineered into a polynucleotide.

In some embodiments, the promoter is heterologous to the cell it is functional in and/or to the other elements to which the promoter is operably linked.

Exemplary promoters include those from viruses, bacteria, fungi, animals, and plants. Embodiments of promoters include those from cauliflower mosaic virus (e.g., p35S), bacteriophage (e.g., pT7), and plants (e.g., pATUBQ10). See, for example, promoters described in Table 7.

In certain embodiments, the promoter is operably linked to nucleotide sequences encoding multiple RNAs, wherein the sequences encoding RNAs are separated by a cleavage site such as a nucleotide sequence encoding a microRNA recognition/cleavage site or a self-cleaving ribozyme (see, e.g., Ferré-D'Amaré and Scott (2014) Cold Spring Harbor Perspectives Biol., 2:a003574). In certain embodiments, the promoter is a pol II promoter operably linked to a nucleotide sequence encoding the RNA. In certain embodiments, the promoter operably linked to one or more polynucleotides encoding elements of a genome-editing system is a constitutive promoter that drives DNA expression in plant cells.

In certain embodiments, the promoter drives DNA expression (e.g., RNA and or protein expression) in the nucleus or in an organelle such as a plastid (e.g., chloroplast) or mitochondrion. Methods and compositions for expression of heterologous genes in plastids that can be used to express genes of interest which include endornaviral RDRP include those disclosed in US patent application publication numbers US20220220493, US20120151627, US20080086788, and US20040040058, which are each incorporated herein by reference in their entireties, Examples of constitutive promoters active in plant cells include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and a nopaline synthase (NOS) and octopine synthase (OCS) promoter from *Agrobacterium tumefaciens*. In certain embodiments, the promoter operably linked to one or more polynucleotides encoding elements of a genome-editing system is a promoter from figwort mosaic virus (FMV), a RUBISCO promoter, or a pyruvate phosphate dikinase (PDK) promoter, which is active in the chloroplasts of mesophyll cells. 5' and 3' replicase recognition sequences recognized by an endornaviral RNA-dependent RNA polymerase (RDRP)

In various aspects of this disclosure, the polynucleotides include 5' and 3' replicase recognition sequences recognized by an endornaviral RNA-dependent RNA polymerase (RDRP). In evaluating the usefulness of such sequences RDRP activity is detected according to standard methods such as those described in Horiuchi et al. Plant Cell Physiol. 42(2):197-203, 2001.

Exemplary bell pepper endornaviral (BPEV) and *Oryza sativa* endornaviral (OsEV) 5' and 3' replicase recognition sequences are depicted in Table 7.

Additionally, conserved structural motifs identified in endornaviral 5' and 3' replicase recognition sequences are shown in Tables 8-13. Such motifs range in size from 30-50 nucleotides (nt), and typically about 40 nt. These motifs are useful for designing engineered polynucleotide sequences that function as endornaviral replicase recognition sequences. Embodiments of endornaviral satellite RNAs include those where the 5' replicase recognition sequence includes one or more of these 5' conserved motifs and/or wherein the 3' replicase recognition sequence includes one or more of these 3' conserved motifs.

Tables 8-10, in particular, respectively describe a 5' conserved motif 1 (which includes a stem-loop structure of about 33 nucleotides including a small turning loop of about-3-6 unpaired nucleotides at the end of a perfectly base-paired stem), a 5' conserved motif 2 (which includes a stem-loop structure of about 35 nucleotides including a large turning loop of about 10-15 unpaired nucleotides at the end of an imperfectly base-paired stem), and a 5' conserved motif 3 (which includes a stem-loop structure of about 28 nucleotides including a small turning loop of about 4 unpaired nucleotides at the end of a stem which is generally perfectly or near-perfectly base-paired). These motifs are respectively depicted in FIGS. 3, 4, and 5. In embodiments, a synthetic endornaviral satellite includes a synthetic 5' replicase recognition sequence including at least two of these 5' conserved motifs (i.e., at least two selected from the group consisting of 5' conserved motif 1, 5' conserved motif 2, and 5' conserved motif 3). In embodiments, a synthetic endornaviral satellite includes a synthetic 5' replicase recognition sequence including a 5' conserved motif 1, a 5' conserved motif 2, and a 5' conserved motif 3; in specific embodiments these motifs are positioned in the 5' replication recognition sequence in 5' to 3' order as written.

Tables 11-13, in particular, respectively describe a 3' conserved motif 1 (which includes a stem-loop structure of about 26 nucleotides including a large turning loop of about 11-15 unpaired nucleotides at the end of a short stem which can contain 1 or 2 non-base-paired bases), a 3' conserved motif 2 includes a stem-loop structure of about 41 nucleotides including a turning loop of variable size (observed: 5-15 unpaired nucleotides) at the end of an imperfectly base-paired stem), and a 3' conserved motif 3 (which includes a stem-loop structure of about 31 nucleotides including a small turning loop of 3-6 (typically 3) unpaired nucleotides at the end of an imperfectly base-paired stem; in some cases the stem has a "kink" formed by an unequal number of non-base-paired nucleotides on opposite sides of the stem). These motifs are respectively depicted in FIGS. 9, 10, and 11. In embodiments, a synthetic endornaviral satellite includes a synthetic 3' replicase recognition sequence including at least two of these 3' conserved motifs (i.e., at least two selected from the group consisting of 3' conserved motif 1, 3' conserved motif 2, and 3' conserved motif 3). In embodiments, a synthetic endornaviral satellite includes a synthetic 3' replicase recognition sequence including a 3' conserved motif 1, a 3' conserved motif 2, and a 3' conserved motif 3; in specific embodiments these motifs are positioned in the 3' replication recognition sequence in 5' to 3' order as written.

The dot bracket notation provided in Tables 8-13 was generated using RNA Fold software for predicting RNA secondary structure based on minimum free energy predictions of base pair probabilities. A dot '·' signifies an unpaired base and a bracket '(' or ')' represents a paired base. Dot bracket notation is further described in Mattei et al., *Nucleic Acids Research*, 42(10): 6146-6157, 2014; Ramlan and Zauner In: International Workshop on Computing With Biomolecules, E. Csuhaj-Varju, R. Freund, M. Oswald and K. Salomaa (Eds.), 27 Aug. 2008, Wien, Austria, pp. 75-86, From: Austrian Computer Society, 2008; and Hofacker et al., *Monatshefte Fur Chemie Chem. Monthly*, 125: 167-188, 1994.

Figure 3:
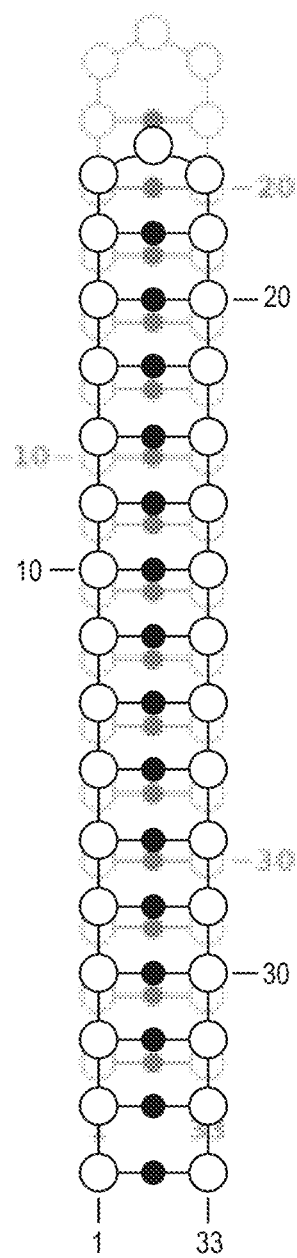
FIG. 3 shows structural motif 1 of an endornaviral 500 base 5'UTR.
Figure 4:
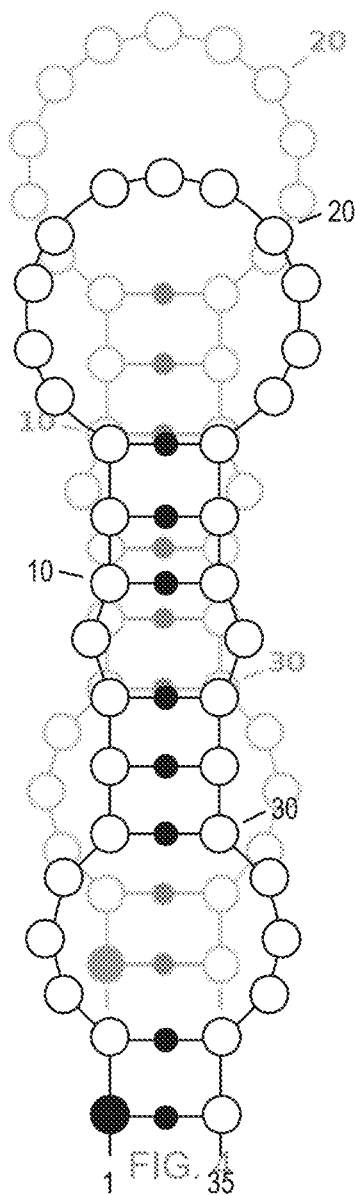
FIG. 4 shows structural motif 2 of an endornaviral 500 base 5'UTR.
Figure 5:
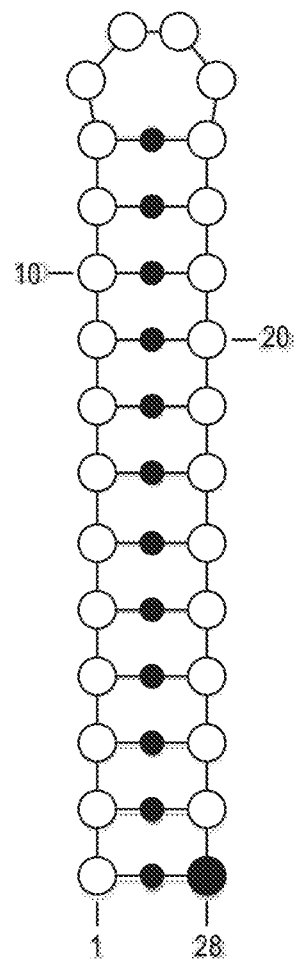
FIG. 5 shows structural motif 3 of an endornaviral 500 base 5'UTR.
Figure 6:
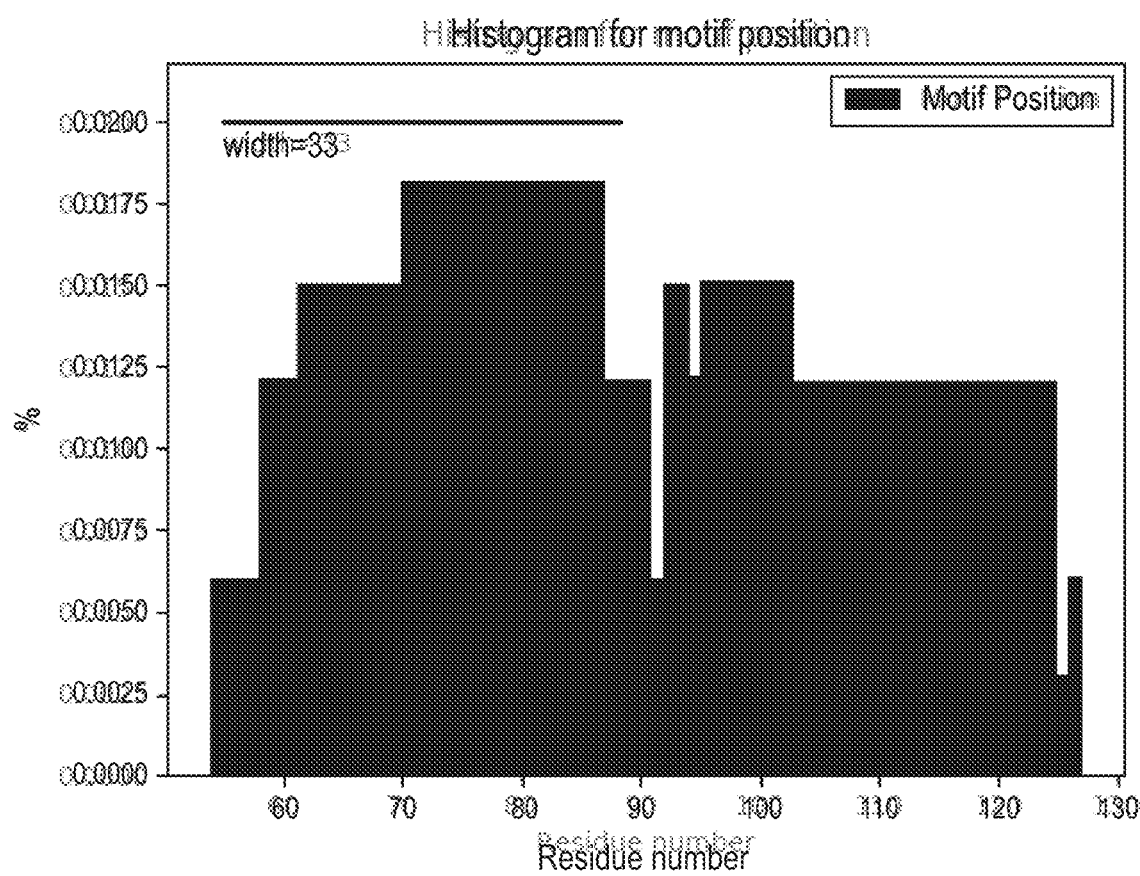
FIG. 6 shows a histogram for structural motif 1 positioning in an endornaviral 500 base 5'UTR.
Figure 7:
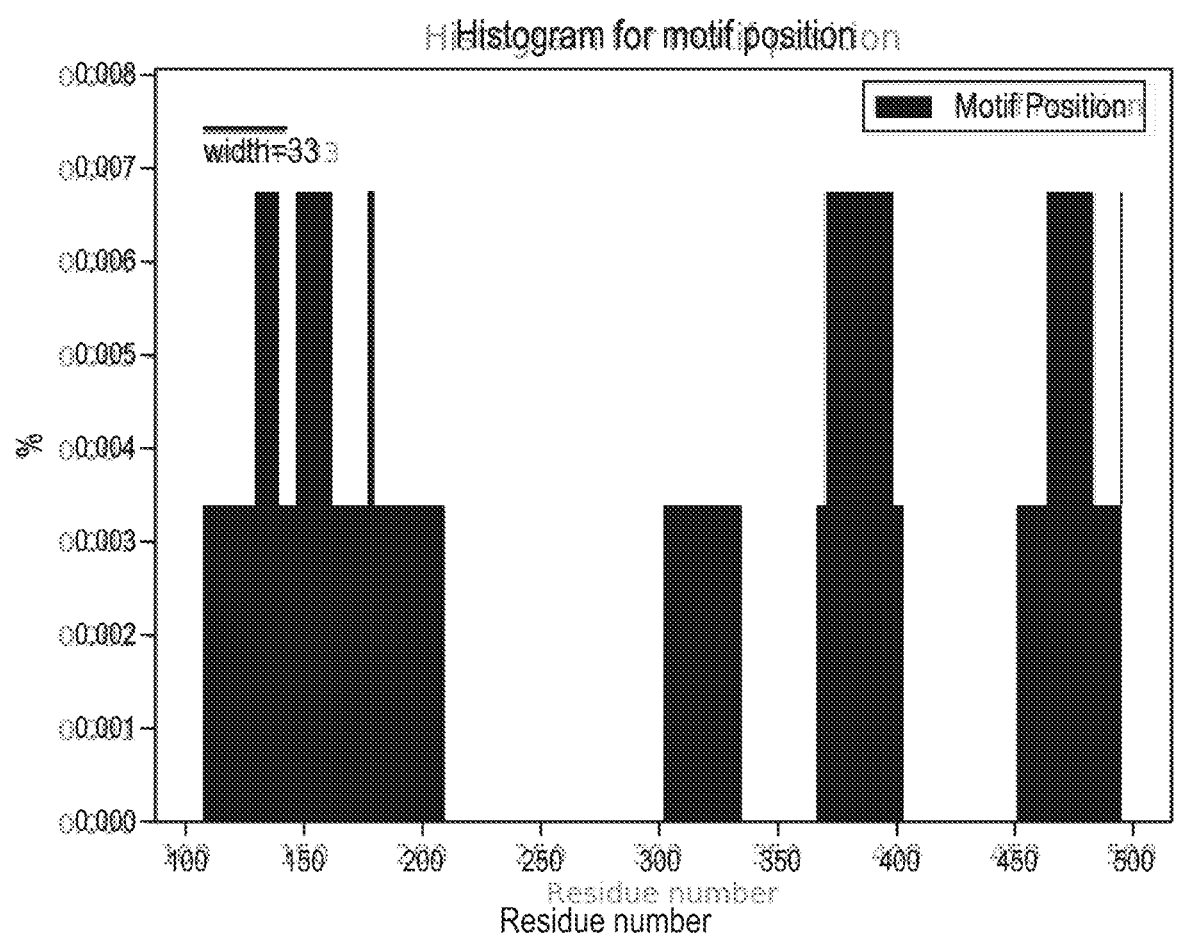
FIG. 7 shows a histogram for structural motif 2 positioning in an endornaviral 500 base 5'UTR.
Figure 8:
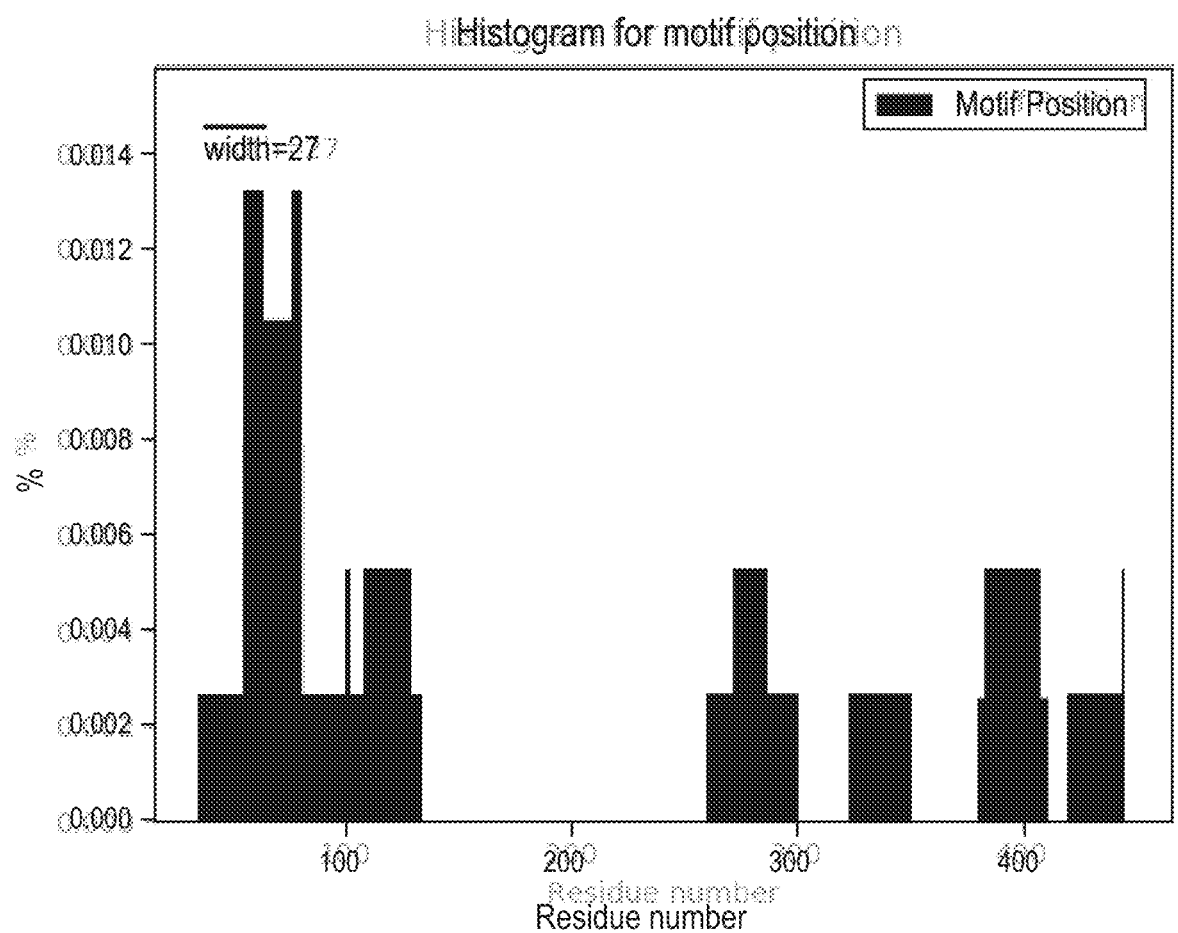
FIG. 8 shows a histogram for structural motif 3 positioning in an endornaviral 500 base 5'UTR.

In some embodiments, the 5' replicase recognition sequence includes a 5' UTR (untranslated region) sequence of an endornavirus (e.g., a commensal endornavirus). Embodiments of the 5' replicase recognition sequence include or comprise the conserved 5'UTR sequence and other 5' replicase recognition sequences described in Table 1. In embodiments, the 5' replicase recognition sequence further includes a genomic sequence of the endornavirus that is natively located 3' to and adjacent to the 5' UTR sequence (see, for example, the endornavirus 5' UTR sequences which include approximate 500 bases of genomic sequence described in Table 1). In still further embodiments, a polynucleotide includes a 5' replicase recognition sequence having at least 80% (e.g., at least 80%, at least 85%, at least 90%, at least 95%, at least 98%, or at least 99%) sequence identity to an RNA sequence encoded by a sequence selected from the group consisting of SEQ ID NOs:1-19, 372-405, 465, and 483-485 (found in Table 1), or to RNA sequence of SEQ ID NO: 580. Structural motifs 1, 2, and 3 in the environment of 500 bases of endornaviral 5'UTRs are depicted in FIGS. 3, 4, and 5, respectively. Location of these motifs within the 5'UTRs are further depicted in histograms for motif position in FIGS. 6, 7, and 8. In certain embodiments, the 5' replicase recognition sequence comprises at least 50, at least 75, at least 100, or at least 200 contiguous nucleotides of the RNA sequence encoded by at least one of SEQ ID NOs: 1-19, 372-405, 465, or 483-485, or the RNA sequence of SEQ ID NO: 580. In certain embodiments, the 5' replicase recognition sequence is recognized by an endornaviral RDRP comprising a polypeptide having at least 85%, 90%, 95%, 98%, or 99% sequence identity to any one of SEQ ID NO: 367, 355-366, 368-371, 456, or 534-577.

Figure 9:
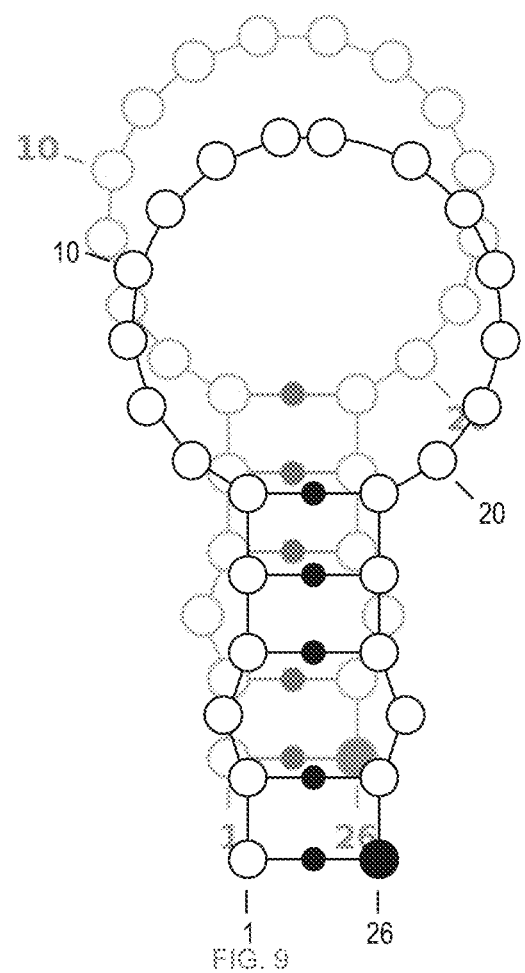
FIG. 9 shows structural motif 1 of an endornaviral 500 base 3'UTR.
Figure 10:
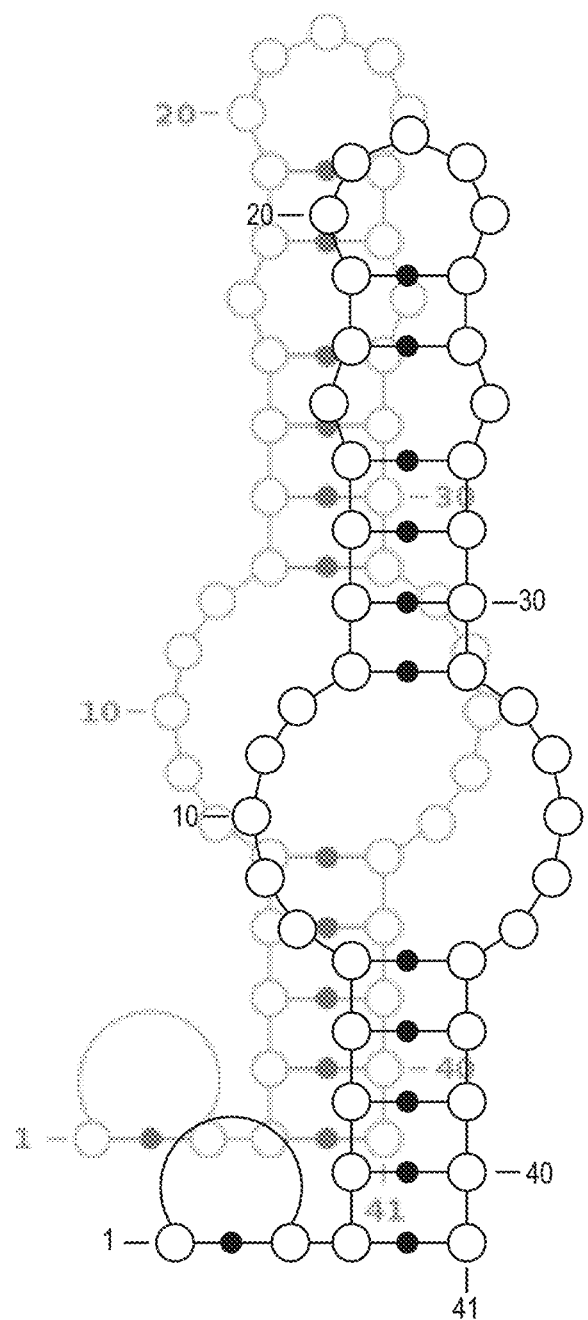
FIG. 10 shows structural motif 2 of an endornaviral 500 base 3'UTR.
Figure 11:
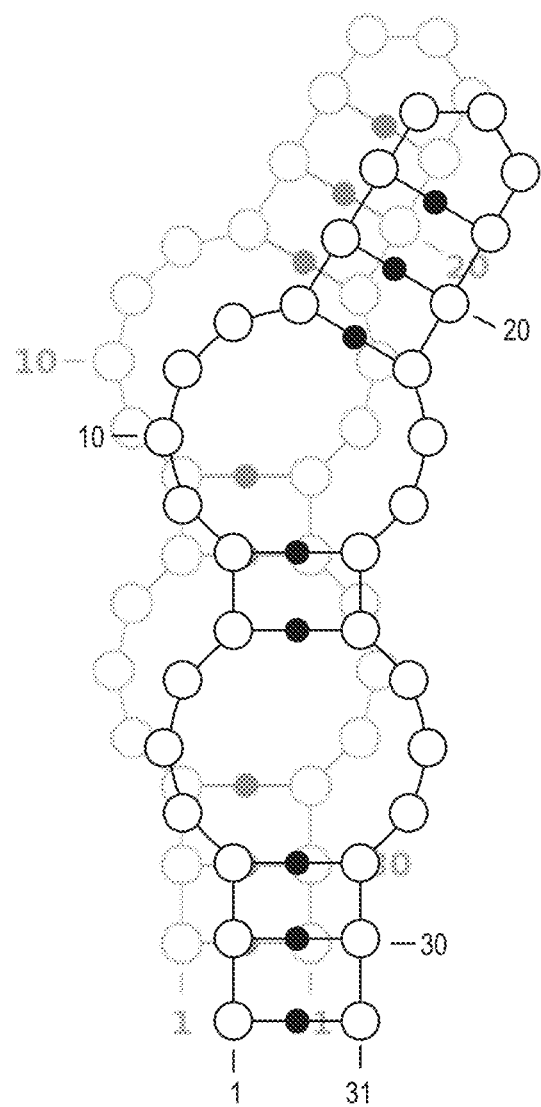
FIG. 11 shows structural motif 3 of an endornaviral 500 base 3'UTR.
Figure 12:
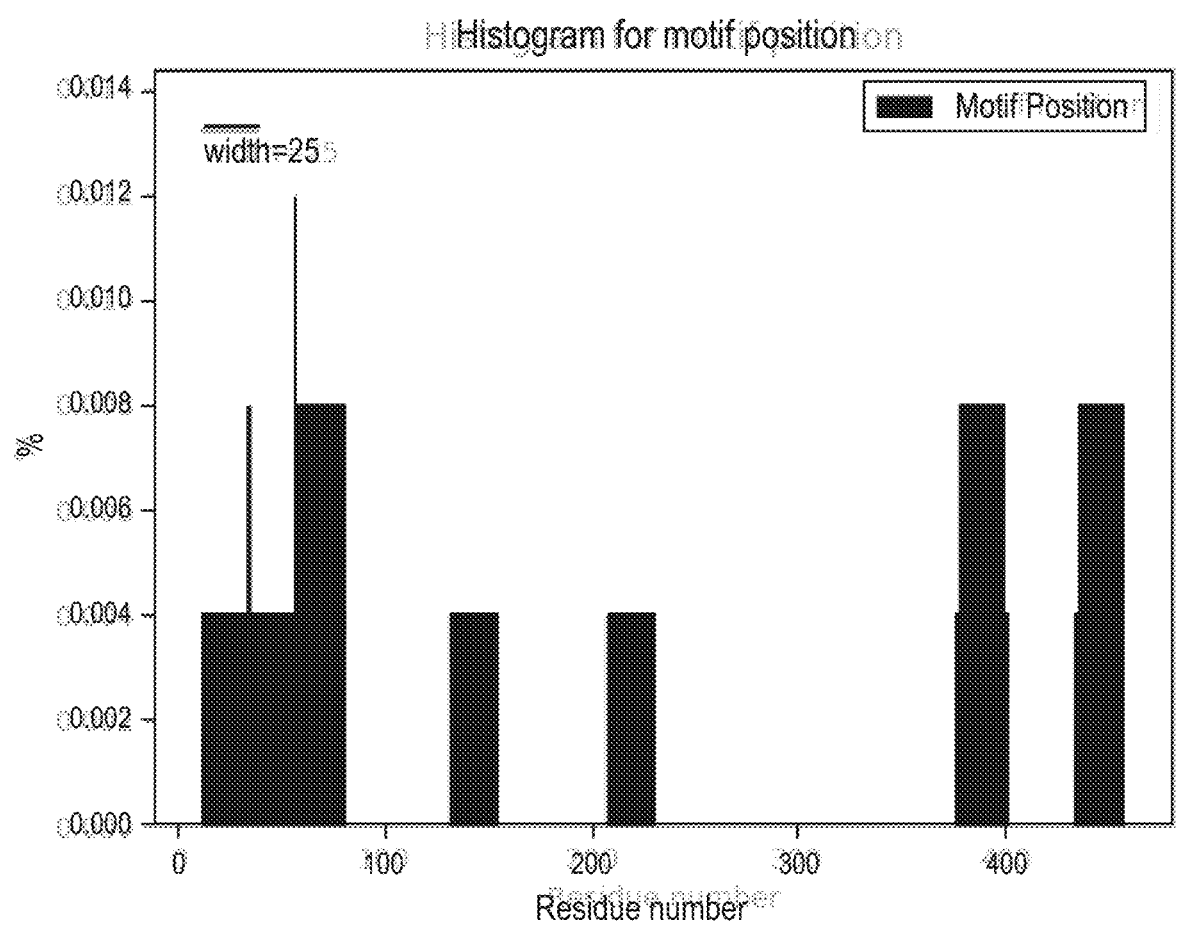
FIG. 12 shows a histogram for structural motif 1 positioning in an endornaviral 500 base 3'UTR.
Figure 13:
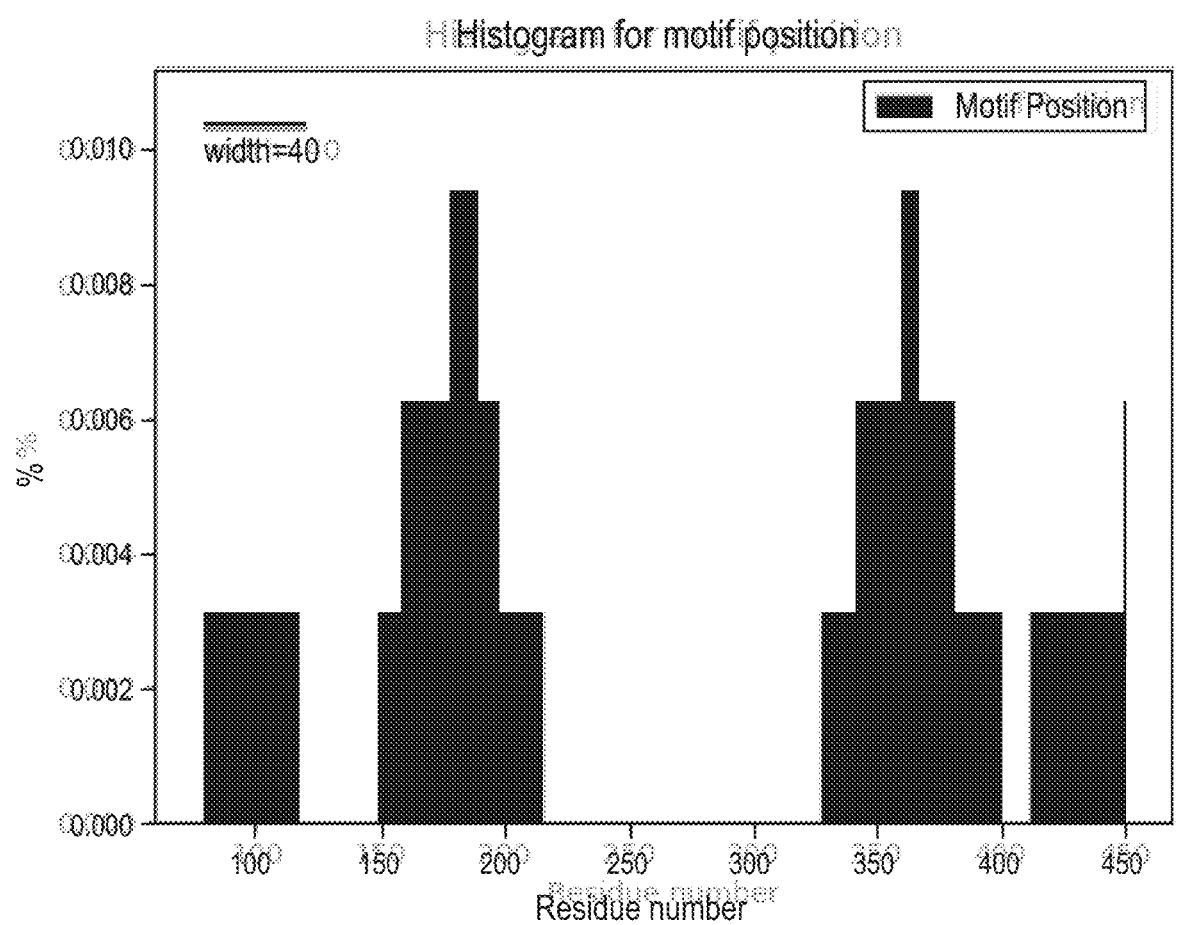
FIG. 13 shows a histogram for structural motif 2 positioning in an endornaviral 500 base 3'UTR.
Figure 14:
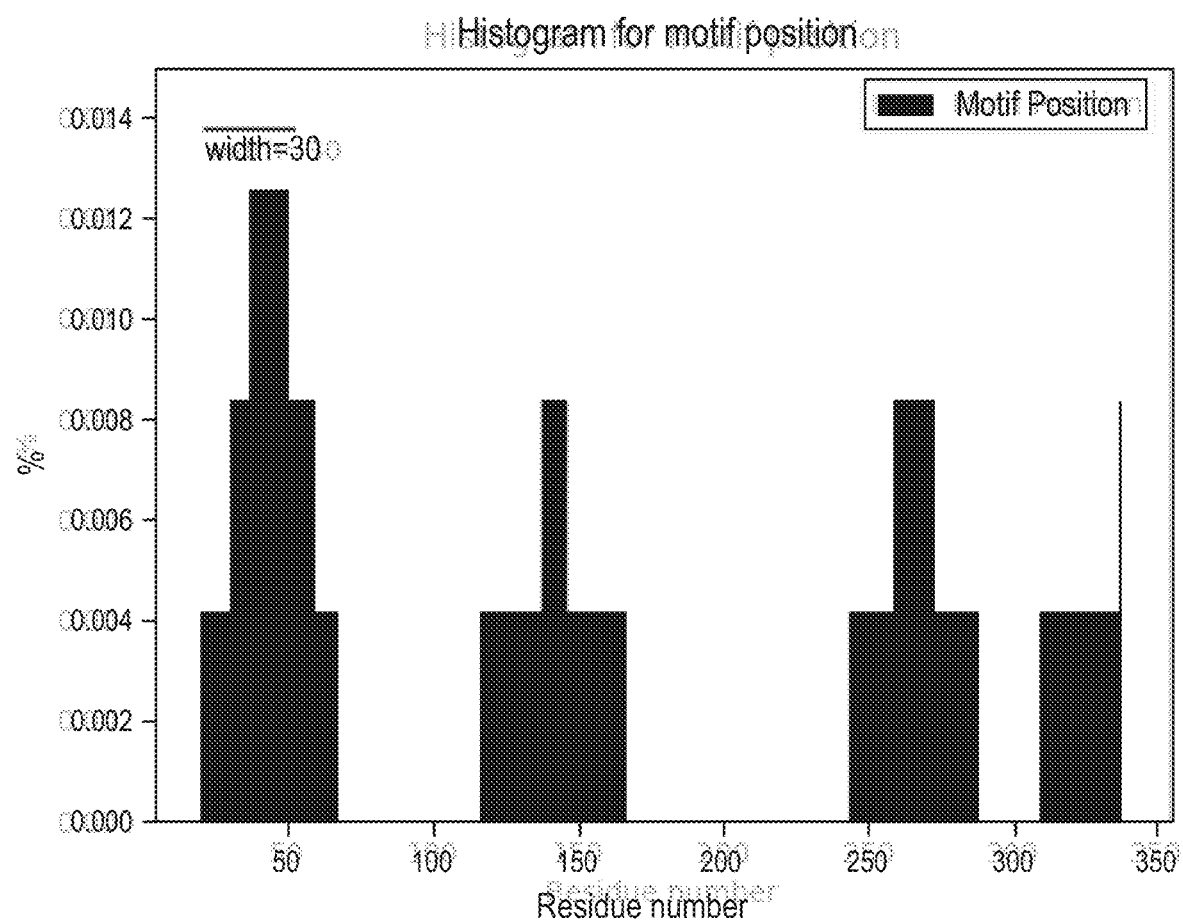
FIG. 14 shows a histogram for structural motif 3 positioning in an endornaviral 500 base 3'UTR.

In other embodiments, the 3' replicase recognition sequence includes a 3' UTR sequence of an endornavirus (e.g., a commensal endornavirus). Embodiments of the 3' replicase recognition sequence include or comprise the conserved 3'UTR sequence and other 3' replicase recognition sequences described in Table 1. In embodiments, the 3' replicase recognition sequence further includes a genomic sequence of the endornavirus that is natively located 5' to and adjacent to the 3' UTR sequence (see, for example, the endornavirus 3' UTR sequences which include approximate 500 bases of genomic sequence described in Table 1). In still further embodiments, a construct includes a 3' replicase recognition sequence having at least 80% (e.g., at least 80%, at least 85%, at least 90%, at least 95%, at least 98%, or at least 99%) sequence identity to an RNA sequence encoded by a sequence selected from the group consisting of SEQ ID Nos:20-38, 406-454, 467, and 486-488 (found in Table 1) and the RNA sequence of SEQ ID NO:580, to the RNA sequence encoded by SEQ ID Nos: 20-38, 406-454, 467, or 486-488, or to the RNA sequence of SEQ ID NO: 581. Structural motifs 1, 2, and 3 in the environment of 500 bases of endornaviral 3'UTRs are depicted in FIGS. 9, 10, and 11, respectively. Location of these motifs within the 5'UTRs are further depicted in histograms for motif position in FIGS. 12, 13, and 14. In certain embodiments, the 3' replicase recognition sequence comprises at least 50, at least 75, at least 100, or at least 200 contiguous nucleotides of at least one of an RNA sequence encoded by SEQ ID Nos: 20-38, 406-454, 467, or 486-488, or the RNA sequence of SEQ ID NO: 581. In certain embodiments, the 3' replicase recognition sequence is recognized by an endornaviral RDRP comprising a polypeptide having at least 85%, 90%, 95%, 98%, or 99% sequence identity to any one of SEQ ID NO: 367, 355-366, 368-371, 456, or 534-577.

In embodiments, the 5' replicase recognition sequence and the 3' replicase recognition sequence are derived from the same endornavirus. In certain embodiments, the 5' and 3' replicase recognition sequences from the same endornavirus comprise a pair set forth in Table 15. In certain embodiments, the 5' and 3' replicase recognition sequences from the same endornavirus comprise the RNAs encoded by SEQ ID NO: 2 and SEQ ID NO: 21, SEQ ID NO: 3 and SEQ ID NO: 22, SEQ ID NO: 4 and SEQ ID NO: 23, SEQ ID NO: 5 and SEQ ID NO: 24, SEQ ID NO: 6 and SEQ ID NO: 25, SEQ ID NO: 7 and SEQ ID NO: 26, SEQ ID NO: 8 and SEQ ID NO: 27, SEQ ID NO: 9 and SEQ ID NO: 28, SEQ ID NO: 10 and SEQ ID NO: 29, SEQ ID NO: 11 or 378 and SEQ ID NO: 30 or 415, SEQ ID NO: 12 and SEQ ID NO: 31 or 452, SEQ ID NO: 13 and SEQ ID NO: 32, SEQ ID NO: 14 and SEQ ID NO: 33, SEQ ID NO: 15 and SEQ ID NO: 34, SEQ ID NO: 16; and SEQ ID NO: 35 or 412, SEQ ID NO: 17 or 404 and SEQ ID NO: 36 or 450, SEQ ID NO: 18 or 379 and SEQ ID NO: 37 or 416, SEQ ID NO: 19 and SEQ ID NO: 38, SEQ ID NO: 372 and SEQ ID NO: 406, SEQ ID NO: 373 and SEQ ID NO: 408, SEQ ID NO: 374 and SEQ ID NO: 409, SEQ ID NO: 375 and SEQ ID NO: 410, SEQ ID NO: 376 and SEQ ID NO: 411, SEQ ID NO: 377 and SEQ ID NO: 414, SEQ ID NO: 380 and SEQ ID NO: 419, SEQ ID NO: 381 and SEQ ID NO: 420, SEQ ID NO: 382 and SEQ ID NO: 421, SEQ ID NO: 383 and SEQ ID NO: 422, SEQ ID NO: 384 and SEQ ID NO: 423, SEQ ID NO: 385 and SEQ ID NO: 424, SEQ ID NO: 386 and SEQ ID NO: 425, SEQ ID NO: 387 and SEQ ID NO: 427, SEQ ID NO: 388 and SEQ ID NO: 429, SEQ ID NO: 389 and SEQ ID NO: 432, SEQ ID NO: 390 and SEQ ID NO: 433, SEQ ID NO: 391 and SEQ ID NO: 434, SEQ ID NO: 392 and SEQ ID NO: 436, SEQ ID NO: 393 and SEQ ID NO: 437, SEQ ID NO: 394 and SEQ ID NO: 438, SEQ ID NO: 395 and SEQ ID NO: 439, SEQ ID NO: 396 and SEQ ID NO: 440, SEQ ID NO: 397 and SEQ ID NO: 441, SEQ ID NO: 398 and SEQ ID NO: 442, SEQ ID NO: 399 and SEQ ID NO: 443, SEQ ID NO: 400 and SEQ ID NO: 445, SEQ ID NO: 401 and SEQ ID NO: 446, SEQ ID NO: 402 and SEQ ID NO: 447, SEQ ID NO: 403 and SEQ ID NO: 448, SEQ ID NO: 405 and SEQ ID NO: 451, SEQ ID NO: 483 and SEQ ID NO: 486, SEQ ID NO: 484 and SEQ ID NO: 487, SEQ ID NO: 485 and SEQ ID NO: 488, SEQ ID NO: 465 and SEQ ID NO: 467; an RNA of SEQ ID NO: 580 and SEQ ID NO: 581, or an RNA having at least 80%, 85%, 90%, 95%, 97%, 98%, or 99% sequence identity thereto. In some embodiments, the 5' replicase recognition sequence, the 3' replicase recognition sequence, and the endornaviral RNA-dependent RNA polymerase are all derived from the same endornavirus. In certain embodiments, the 5' RNA replicase recognition sequence and the 3' RNA replicase recognition sequence are obtained from endornaviral genomes having at least 85%, 90%, 95%, 98%, or 99% sequence identity to one another. In certain embodiments, the 5' RNA replicase recognition sequence, the 3' RNA replicase recognition sequence, and the RDRP are obtained from endornaviral genomes having at least 85%, 90%, 95%, 98%, or 99% sequence identity to one another. In certain embodiments, the 5' RNA replicase recognition sequence, a 3' RNA replicase recognition sequence, and RDRP coding region are obtained from two endornaviral genomes wherein the members of each pair of the 5' RNA replicase recognition sequences, the 3' RNA replicase recognition sequences, and/or the RDRP coding sequences have at least 85%, 90%, 95%, 98%, or 99% sequence identity to one another. In other embodiments, the 5' replicase recognition sequence and the 3' replicase recognition sequence are derived from different endornaviruses. In embodiments, the 5' replicase recognition sequence and/or the 3' replicase recognition sequence are derived from an endornavirus selected from the group consisting of Bell pepper Endornavirus (BPEV), *Phaseolus vulgaris* alphaendornavirus 1 (PvEV-1), *Phaseolus vulgaris* endornavirus 2 (PvEV-2), and *Helianthus annuus* alphaendornavirus isolate BJ. In embodiments, the 5' replicase recognition sequence and/or the 3' replicase recognition sequence are derived from an endornavirus selected from the group consisting of *Basella alba* alphaendornavirus 1, Bell pepper alphaendornavirus, Cluster bean alphaendornavirus 1, *Cucumis melo* alphaendornavirus, *Helianthus annuus* alphaendornavirus, *Hordeum vulgare* alphaendornavirus, Hot pepper alphaendornavirus, *Lagenaria siceraria* alphaendornavirus, *Oryza rufipogon* alphaendornavirus, *Oryza sativa* alphaendornavirus, *Persea americana* alphaendornavirus 1, *Phaseolus vulgaris* alphaendornavirus 1, *Phaseolus vulgaris* alphaendornavirus 2, *Phaseolus vulgaris* alphaendornavirus 3, *Vicia faba* alphaendornavirus, Winged bean alphaendornavirus 1, and Yerba mate alphaendornavirus. In further embodiments, the 5' replicase recognition sequence and/or the 3' replicase recognition sequence are derived from an endornavirus selected from the group consisting of *Basella alba* alphaendornavirus strain Oahu4, Bell pepper alphaendornavirus isolate Antioquia May 5, Bell pepper alphaendornavirus isolate BPEV_Panama, Bell pepper alphaendornavirus isolate LA-E, Bell pepper alphaendornavirus isolate Marinilla, Bell pepper alphaendornavirus isolate May8A, Bell pepper alphaendornavirus isolate MS1, Bell pepper alphaendornavirus isolate San Vicente, Bell pepper alphaendornavirus isolate XJ, Bell pepper endornavirus isolate BPEV-YW, Bell pepper endornavirus isolate 1j, Bell pepper endornavirus isolate Maor, Bell pepper endornavirus isolate Penol, Bell pepper endornavirus strain IS, Brown algae endornavirus 1 Chiba1, Brown algae endornavirus 2 Chiba2, *Capsicum frutescens* endornavirus 1 isolate LA-A, *Capsicum frutescens* endornavirus 1 isolate LA-B, *Capsicum frutescens* endornavirus 1 isolate LA-C, *Capsicum frutescens* endornavirus 1 isolate MC7, Cluster bean endornavirus 1 isolate 593049, Cucumber endornavirus 1 isolate CuEVI, *Cucumis melo* alphaendornavirus isolate IL, *Cucumis melo* alphaendornavirus strain CmEV/BRA/TO-23/2014, *Cucumis melo* endornavirus isolate CL-01, *Cucumis melo* endornavirus isolate CL-01, *Fagopyrum esculentum* endornavirus 2 isolate SK, Geranium *carolinianum* endornavirus, *Helianthus annuus* alphaendornavirus isolate BJ, *Hordeum vulgare* alphaendornavirus isolate HYT-37, *Hordeum vulgare* alphaendornavirus isolate HYT-38, *Lagenaria siceraria* endornavirus-California, *Lagenaria siceraria* endornavirus-Hubei, Lily alphaendornavirus isolate BJ, *Oryza sativa* alphaendornavirus isolate BXCFS134, *Oryza sativa* alphaendornavirus isolate DHCFY127945, *Persea*

*americana* endornavirus isolate Fuerte, *Phaseolus* endornavirus 3 isolate LA, *Phaseolus vulgaris* alphaendornavirus 1 isolate PVAV1/CG6.

Other embodiments of 5' and/or 3' replicase recognition sequences are RNA sequences that include, or that are derived from, respectively, the 5' terminal region and 3' terminal region of an endornaviral genome, wherein the 5' and/or 3' replicase recognition sequences permit recognition and replication by an endornaviral RdRP (e.g., by the cognate RdRP identified from the same endornaviral genome). Such embodiments include, for example, a replicase recognition sequence that includes at least 50, at least 100, at least 150, at least 200, at least 250, at least 300, at least 350, at least 400, at least 450, or at least 500 contiguous nucleotides located in the 5' or 3' terminal regions of an endornaviral genome. In some embodiments, the 5' replicase recognition sequence includes less than about 300 nucleotides or less than about 400 nucleotides (e.g., about 200 or about 225 or about 250 nucleotides). In some embodiments, the 5' replicase recognition sequence is a longer (e.g., at least 400, at least 500, at least 600, at least 700, at least 800, at least 900, or at least 1000 nucleotides) or extended 5' replicase recognition sequence. In some embodiments the 5' replicase recognition sequence further includes nucleotides that extend up to or past the location of the endogenous "nick" of the wild-type endornaviral genome. In some embodiments the 5' replicase recognition sequence further includes nucleotides that extend into the region of the endornaviral genome that encodes the polyprotein. In certain embodiments, synthetic endornaviral satellite RNAs that include a longer (e.g., at least 400, at least 500, at least 600, at least 700, at least 800, at least 900, or at least 1000 nucleotides) or extended 5' replicase recognition sequence are replicated more efficiently by their cognate endornaviral RdRP than are otherwise similar satellite RNAs with a shorter (e.g., ~225 nucleotides or less than about 300 nucleotides or less than about 400 nucleotides) 5' replicase recognition sequence. Other embodiments include a replicase recognition sequence of at least 30 nucleotides in length (e.g., at least 30, at least 40, at least 50, at least 60, at least 70, at least 80, at least 90, or at least 100 nucleotides) and having at least 80% (e.g., at least 80%, at least 85%, at least 90%, at least 95%, or at least 98%) sequence identity with a segment of equivalent length located within the 5'-most or 3'-most 500 nucleotides of an endornaviral genome.

In some embodiments, the RNA sequence includes coding RNA, non-coding RNA, or both coding and non-coding RNA as is described herein.

In embodiments, 5' and 3' replicase recognition sequences useful in building polynucleotide include one or more of the following features: (1) function as 5' and 3' replicase recognition sequences (e.g., any sequence recognized to drive expression by endornavirus replicase), (2) include a secondary structure (as is described above), (3) sequence identity (sequences which are identical to any of those described in Tables 1 and 7 as well as sequences having 50%, 60%, 70%, 80%, 85%, 90%, 91%, 92%, 93%, 94%, 95%, 96%, 97%, 98%, 99% or 100% sequence identity to one or more 5' and 3' replicase recognition sequences described in Tables 1 and 7), and (4) origin (e.g., any appropriate sequence from any endornavirus). In embodiments, such sequences are naturally occurring, modified, and/or synthetic sequences. Capture paired sequences (from the same endornavirus) and mixed/matched sequences (from different endornaviruses) as is described herein are also useful.

RNA Elements

The RNA molecule optionally includes one or more of the following additional elements.

RNA Encoding an Endornaviral RDRP

Such aforementioned additional RNA elements can include RNAs encoding an endornaviral RDRP. Examples of DNA sequences encoding an endornaviral RDRP include the corresponding sequences of the endornaviral genomes set forth in Table 1 under descriptors "NC_XXXXXX" which refer to the National Center for Biotechnology Information database accession number for entries in the world wide web internet database "ncbi.nlm.nih.gov/nuccore." Examples of DNA sequences encoding endornaviral RDRP and endornaviral RDRP protein sequences also include the sequences set forth in Table 14 as well as the DNA, encoded RNA, and protein sequences having at least 85%, 90%, 95%, 98%, or 99% sequence identity thereto. In embodiments, an endornaviral RDRP sequence has at least 80% (e.g., at least 80%, at least 85%, at least 90%, at least 95%, at least 98%, or at least 99%) sequence identity to a sequence selected from the group consisting of SEQ ID nOs: 355-371, 456, and 534-577. In embodiments, a sequence encoding an endornaviral RDRP has at least 80% (e.g., at least 80%, at least 85%, at least 90%, at least 95%, at least 98%, or at least 99%) sequence identity to a sequence selected from the group consisting of SEQ ID nOs: 338-354, 455, 457, 459, 468-469, and 489-533. In embodiments, the endornaviral RDRP is derived from an endornavirus selected from the group consisting of Bell pepper Endornavirus (BPEV), *Phaseolus vulgaris* alphaendornavirus 1 (PvEV-1), *Phaseolus vulgaris* endornavirus 2 (PvEV-2), and *Helianthus annuus* alphaendornavirus isolate BJ. In embodiments, the endornaviral RDRP is derived from an endornavirus selected from the group consisting of *Basella alba* alphaendornavirus 1, Bell pepper alphaendornavirus, Cluster bean alphaendornavirus 1, *Cucumis melo* alphaendornavirus, *Helianthus annuus* alphaendornavirus, *Hordeum vulgare* alphaendornavirus, Hot pepper alphaendornavirus, *Lagenaria siceraria* alphaendornavirus, *Oryza rufipogon* alphaendornavirus, *Oryza sativa* alphaendornavirus, *Persea americana* alphaendornavirus 1, *Phaseolus vulgaris* alphaendornavirus 1, *Phaseolus vulgaris* alphaendornavirus 2, *Phaseolus vulgaris* alphaendornavirus 3, *Vicia faba* alphaendornavirus, Winged bean alphaendornavirus 1, and Yerba mate alphaendornavirus. In further embodiments, the 5' replicase recognition sequence and/or the 3' replicase recognition sequence are derived from an endornavirus selected from the group consisting of *Basella alba* alphaendornavirus strain Oahu4, Bell pepper alphaendornavirus isolate Antioquia May 5, Bell pepper alphaendornavirus isolate BPE-V_Panama, Bell pepper alphaendornavirus isolate LA-E, Bell pepper alphaendornavirus isolate Marinilla, Bell pepper alphaendornavirus isolate May8A, Bell pepper alphaendornavirus isolate MS1, Bell pepper alphaendornavirus isolate San Vicente, Bell pepper alphaendornavirus isolate XJ, Bell pepper endornavirus isolate BPEV-YW, Bell pepper endornavirus isolate 1j, Bell pepper endornavirus isolate Maor, Bell pepper endornavirus isolate Penol, Bell pepper endornavirus strain IS, Brown algae endornavirus 1 Chiba1, Brown algae endornavirus 2 Chiba2, *Capsicum frutescens* endornavirus 1 isolate LA-A, *Capsicum frutescens* endornavirus 1 isolate LA-B, *Capsicum frutescens* endornavirus 1 isolate LA-C, *Capsicum frutescens* endornavirus 1 isolate MC7, Cluster bean endornavirus 1 isolate 593049, Cucumber endornavirus 1 isolate CuEVI, *Cucumis melo* alphaendornavirus isolate IL, *Cucumis melo* alphaendornavirus strain CmEV/BRA/TO-23/2014, *Cucumis melo* endornavirus isolate CL-01, *Cucumis melo* endornavirus isolate CL-01, *Fagopyrum esculentum* endornavirus 2 isolate SK, Geranium *carolinianum* endornavirus, *Helianthus annuus* alphaendornavirus isolate BJ, *Hordeum vulgare* alphaendornavirus isolate HYT-37, *Hordeum vulgare* alphaendornavirus isolate HYT-38, *Lagenaria siceraria* endornavirus-California, *Lagenaria siceraria* endornavirus-Hubei, Lily alphaendornavirus isolate BJ, *Oryza sativa* alphaendornavirus isolate BXCFS134, *Oryza sativa* alphaendornavirus isolate DHCFY127945, *Persea americana* endornavirus isolate Fuerte, *Phaseolus* endornavirus 3 isolate LA, *Phaseolus vulgaris* alphaendornavirus 1 isolate PVAV1/CG6.

RNA Encoding a Viral Movement Protein (MP)

Without being bound to mechanistic hypotheses, the viral movement protein is believed to bind to the RNA and to assist its movement (and thus the movement of the cargo RNA) throughout the plant, e.g., via the plasmodesmata. Exemplary MPs include, without limitation, those in tobacco mosaic virus, cowpea mosaic virus, potato leafroll virus, tomato spotted wilt virus, and tomato mosaic virus. MPs from a variety of viruses are described in Table 3. An exemplary pepper mild mottle virus MP (PMMoV MP) is described in Table 7.

tRNA-Like Sequences (TLS)

TLS can trigger mobility of otherwise nonmobile RNAs, assisting to increase systemic delivery of the RNA molecule. TLS include tRNAs and tRNA-like sequences identified from other genetic elements, e.g., mRNAs. An exemplary TLS, an isoleucine tRNA, is described in Table 7. Other mobile RNAs including TLS identified in *Arabidopsis* which are useful for building polynucleotides are described in Table 4. In assembling Table 4, mobile mRNA sequences were downloaded from the PLAMOM database for *Arabidopsis*. The tRNA "seed alignment" from the RFAM database was downloaded in stockholm format (multiple sequence alignment+secondary structure). A covariance model was created with INFERNAL for the tRNA stockholm alignment. PLAMOM mRNA sequences were scanned for significant similarity to tRNAs based on primary and secondary structure features. mRNA sequences with significant hits (E-val<1) were then saved to a fasta file. In one embodiment, such a tRNA-like sequence includes a tRNA-like sequence from an *Arabidopsis* Flowering Time T (FT) mRNA. In some embodiments, the RNA molecule includes at least one RNA encoding a viral MP, a tRNA-like sequence from an *Arabidopsis* FT mRNA, and an encapsidation recognition sequence comprising TMV-OAS. In some embodiments, the tRNA-like sequence (TLS) selected from the group consisting of SEQ ID Nos: 114-161. In some embodiments, the TLS comprises a modified tRNA-like sequence that has at least 90%, 95%, 98%, or 99% sequence identity to a scaffold tRNA-like sequence comprising an RNA sequence encoded by a DNA molecule selected from the group consisting of SEQ ID Nos: 114-161 and that maintains the secondary structure of the scaffold tRNA-like sequence.

Viral Coat Protein and Encapsidation Recognition Sequence (ERS)

Viral coat protein (CP) can be provided, e.g., by co-expression of a recombinant construct encoding the CP or by native expression by a virus endogenous to or introduced into a plant cell. Encapsidation of an RNA molecule by the CP is achieved provided it contains an encapsidation recognition sequence (ERS), e.g., an origin of assembly sequence (OAS). Table 2 describes several OAS and CP sequences from a variety of viruses useful in engineering constructs. Table 7 describes constructs which include tobacco mosaic virus (TMV) coat protein and OAS. In embodiments, the OAS is positioned near the 3' end of a construct, e.g., within the 3' region of a cargo sequence. For example, in some embodiments, the OAS is found 5' to the 3' replicase recognition sequences (e.g., the BPEV or OsEv 3' replicase recognition sequences). In embodiments, a TMV-OAS positioned at the 3' end of the RNA molecule is recognized by the TMV coat protein, leading to assembly of a TMV-like virion around the RNA. Alternatively, the RNA molecule can be associated with or complexed with a polypeptide. In an embodiment, the RNA molecule includes an RNA aptamer that can be recognized and bound by a polypeptide such as an antibody. In another embodiment, the RNA molecule includes at least one MS2 stem-loop (from the MS2 bacteriophage genome), which is recognized and bound by the MS2 bacteriophage coat protein (which can optionally be fused to another polypeptide, such as GFP).

Ribozymes

Embodiments of the engineered construct include, without limitation, at least one self-cleaving ribozyme, a ligand-responsive self-cleaving ribozyme (aptazyme), a trans-cleaving ribozyme designed to cleave a target sequence (e.g., a trans-cleaving hammerhead ribozyme designed to cleave the pepper PDS sequence, see Table 7), a hepatitis delta virus (HDV) ribozyme (see Table 7), or a hammerhead ribozyme (see Table 7). In various embodiments, multiple ribozymes are included in a polynucleotide. Typically, such a ribozyme is located 5' to the 5' replicase recognition sequence or 3' to the 3' replicase recognition sequence. Non-limiting examples for positioning such ribozymes including positioning of multiple ribozymes in a construct are shown in Table 7.

Intronic Sequences

In embodiments, intronic sequences are included in an engineered construct. Exemplary intronic sequences are described in Table 6. In various embodiments, intronic sequences and their positioning within a polynucleotide are depicted in Table 7 (see, for example, Constructs 10 and 11).

RNA Promoters

Such aforementioned additional RNA elements can include RNA promoters recognized by an RNA Promoter Dependent RNA polymerase (RPDRP) and/or RNA molecules encoding an RNA Promoter Dependent RNA polymerase (RPDRP). Examples of such RNA promoters and RPDRP include a Brome Mosaic Virus RNA promoter and RPDRP (Siegal et al. 1998, doi: 10.1073/pnas.95.20.11613). In certain embodiments, such RNA promoters can be placed either 5' and/or 3' to an RNA molecule comprising a 5' replicase recognition sequence, a cargo RNA, and a 3' replicase recognition sequence to permit production of either or both + and − strands of the RNA molecule when the RPDRP is provided. In certain embodiments, such RNA promoters can be operably linked to a cargo RNA molecule and/or to any additional RNA element to permit production of the corresponding cargo and/or additional RNA when the RPDRP is provided.

Other Elements

Embodiments of the engineered constructs further include other additional elements known in the art. Such elements include (a) a discrete expression cassette including a second promoter operably linked to a DNA sequence to be transcribed, and optionally a terminator element (see, e.g., Constructs 9 and 10 in Table 7); (b) an expression-enhancing element (e.g., a DNA encoding an expression-enhancing intronic sequence); (c) a DNA sequence encoding a marker (e.g., a selectable marker such as DNA encoding an antibiotic resistance or herbicide resistance sequence; DNA encoding a scoreable marker or detectable label (e.g., a beta-glucuronidase, a fluorescent protein, luciferase, etc.); (d) a DNA aptamer; €) a DNA sequence encoding an RNA aptamer; (f) T-DNA left and right border DNA sequences; (g) a spacer DNA sequence; (h) a DNA sequence encoding a transcription factor binding site; (i) a DNA sequence encoding a localization sequence (e.g., DNA encoding a target peptide, such as a nuclear localization signal (NLS), a mitochondrial localization signal, or a plastid localization signal); or j) a DNA sequence encoding at least one sequence-specific recombinase recognition site (e.g., a pair of sequence-specific recombinase recognition sites that are recognized by a given recombinase); and (k) a DNA sequence encoding a transcript-stabilizing or transcript-destabilizing sequence (see, e.g., US Published Patent Application 2007/0011761; Geisberg et al. Cell (2014) 156: 812-824).

Cargo RNA Sequences

Provided herein are recombinant polynucleotides including a cargo RNA sequence. In some embodiments, the recombinant polynucleotide includes a single cargo RNA sequence. In other embodiments, the recombinant polynucleotide includes at least two cargo RNA sequences, e.g., 2, 3, 4, 5, 6, 7, 8, 9, 10, or more than 10 cargo RNA sequences.

Length

In embodiments, the recombinant DNA molecule including the DNA sequence encoding the RNA molecule includes a cargo RNA sequence. Typically, the cargo RNA sequence is up to about 14 kilobases (kb) in length. Exemplary lengths of the cargo RNA sequence range from 100 bases, 200 bases, 300 bases, 400 bases, 500 bases, 600 bases, 700 bases, 800 bases, 900 bases, 1 kb, 2 kb, 3 kb, 4 kb, 5 kb, 6 kb, 7 kb, 8 kb, 9 kb, 10 kb, 11 kb, 12 kb, 13 kb, and 14 kb in length. Other exemplary lengths of the cargo RNA sequence are less than or equal to 100 nucleotides (nt) such as 20 nt, 30 nt, 40 nt, 50 nt, 60 nt, 70 nt, 80 nt, 90 nt, and 100 nt. In some embodiments, the cargo RNA sequence is greater than 14 kb, for example, 15 kb, 16 kb, 17 kb, 18 kb, 19 kb, or even 20 kb. In embodiments, the cargo RNA sequence includes: (a) at least one coding sequence, (b) at least one non-coding sequence, or (c) both at least one coding sequence and at least one non-coding sequence. Such cargo RNA sequences include combinations of coding/non-coding sequence; multiple non-coding/coding sequences; as well as aptamers, ribozymes, and other elements as is described herein.

Coding

In embodiments, the cargo RNA sequence includes at least one coding sequence (e.g., a translatable sequence). In some embodiments, the coding sequence is accordingly a protein or a polypeptide. In some embodiments, the RNA molecule further includes an internal ribosome entry site (IRES) located 5' and immediately adjacent to the at least one coding sequence. In yet other embodiments, the cargo RNA sequence includes multiple coding sequences, and the RNA molecule further includes an IRES located 5' and immediately adjacent to each of the coding sequences. Exemplary IRES sequences are depicted in Table 5. Further exemplary polynucleotides including IRES positioned in various constructs are shown in Table 7.

In embodiments, the cargo RNA sequence encodes at least one protein or polypeptide that provides a desirable trait in a plant in which the protein or polypeptide is expressed. Non-limiting examples of polypeptides useful in agricultural applications include, for example, bacteriocins, lysins, antimicrobial peptides, nodule C-rich peptides, and bacteriocyte regulatory peptides. Such polypeptides can be used to alter the level, activity, or metabolism of target microorganisms for increasing the fitness of beneficial insects (such as honeybees and silkworms) or for decreasing the fitness of pest invertebrates (such as aphids, caterpillars, beetle larvae, and mites). Embodiments of agriculturally useful polypeptides include peptide toxins, such as those naturally produced by entomopathogenic bacteria (e.g., *Bacillus thuringiensis, Photorhabdus luminescens, Serratia entomophila*, or *Xenorhabdus nematophila*), as is known in the art. Embodiments of agriculturally useful polypeptides include polypeptides (including small peptides such as cyclodipeptides or diketopiperazines) for controlling agriculturally important pests or pathogens, e.g., antimicrobial polypeptides or antifungal polypeptides for controlling diseases in plants, or pesticidal polypeptides (e.g., insecticidal polypeptides and/or nematicidal polypeptides) for controlling invertebrate pests such as insects or nematodes. Embodiments of antimicrobial polypeptides include cathelicidins, cecropins, beta-defensins, amphibian antimicrobial peptides (e.g., aurein-like peptides, esculentin, gaegurin, brevinin, rugosin, ranatuerin, ranacyclin, uperin, ocellatin, grahamin, nigrocin, dermoseptin, temporin, bombinin, maximin), enterocins, ponicerins, megourins, apidaecins, abaecins, attacin, bacteriocins and lantibiotics, dermcidin, formaecin, halocidins, lactocin, tachystatins, and some insecticidal toxins produced by spiders and scorpions. Embodiments of agriculturally useful polypeptides include antibodies, nanobodies, and fragments thereof, e.g., antibody or nanobody fragments that retain at least some (e.g., at least 10%) of the specific binding activity of the intact antibody or nanobody. Embodiments of agriculturally useful polypeptides include transcription factors, e.g., plant transcription factors; see, e.g., the "AtTFDB" database listing the transcription factor families identified in the model plant *Arabidopsis thaliana*), publicly available at agris-knowledgebase[dot]org/AtTFDB/. Embodiments of agriculturally useful polypeptides include nucleases, for example, exonucleases or endonucleases (e.g., Cas nucleases such as Cas9 or Cas12a). Embodiments of agriculturally useful polypeptides further include cell-penetrating peptides, enzymes (e.g., amylases, cellulases, peptidases, lipases, chitinases), peptide pheromones (for example, yeast or fungal mating pheromones, invertebrate reproductive and larval signaling pheromones, see, e.g., Altstein (2004) Peptides, 25:1373-1376). Embodiments of agriculturally useful polypeptides confer a beneficial agronomic trait, e.g., herbicide tolerance, insect control, modified yield, increased fungal or oomycte disease resistance, increased virus resistance, increased nematode resistance, increased bacterial disease resistance, plant growth and development, modified starch production, modified oils production, high oil production, modified fatty acid content, high protein production, fruit ripening, enhanced animal and human nutrition, production of biopolymers, environmental stress resistance, pharmaceutical peptides and secretable peptides, improved processing traits, improved digestibility (e.g., reduced levels of toxins or reduced levels of compounds with "anti-nutritive" qualities such as lignins, lectins, and phytates), enzyme production, flavor, nitrogen fixation, hybrid seed production, fiber production, and biofuel production. Non-limiting examples of agriculturally useful polypeptides include polypeptides that confer herbicide resistance (U.S. Pat. Nos. 6,803,501; 6,448,476; 6,248,876; 6,225,114; 6,107,549; 5,866,775; 5,804,425; 5,633,435; and 5,463,175), increased yield (US Pat. Nos. RE38, 446; 6,716,474; 6,663,906; 6,476,295; 6,441,277; 6,423,828; 6,399,330; 6,372,211; 6,235,971; 6,222,098; and 5,716,837), insect control (U.S. Pat. Nos. 6,809,078; 6,713,063;

6,686,452; 6,657,046; 6,645,497; 6,642,030; 6,639,054; 6,620,988; 6,593,293; 6,555,655; 6,538,109; 6,537,756; 6,521,442; 6,501,009; 6,468,523; 6,326,351; 6,313,378; 6,284,949; 6,281,016; 6,248,536; 6,242,241; 6,221,649; 6,177,615; 6,156,573; 6,153,814; 6,110,464; 6,093,695; 6,063,756; 6,063,597; 6,023,013; 5,959,091; 5,942,664; 5,942,658, 5,880,275; 5,763,245; 5,763,241; 10,017,549; 10,233,217; 10,487,123; 10,494,408; 10,494,409; 10,611,806; 10,612,037; 10,669,317; 10,827,755; 11,254,950; 11,267,849; 11,130,965; 11,136,593; and 11,180,774), fungal disease resistance (U.S. Pat. Nos. 6,653,280; 6,573,361; 6,506,962; 6,316,407; 6,215,048; 5,516,671; 5,773,696; 6,121,436; 6,316,407; and 6,506,962), virus resistance (U.S. Pat. Nos. 6,617,496; 6,608,241; 6,015,940; 6,013,864; 5,850,023; and 5,304,730), nematode resistance (U.S. Pat. No. 6,228,992), bacterial disease resistance (U.S. Pat. No. 5,516,671), plant growth and development (U.S. Pat. Nos. 6,723,897 and 6,518,488), starch production (U.S. Pat. Nos. 6,538,181; 6,538,179; 6,538,178; 5,750,876; 6,476,295), modified oils production (U.S. Pat. Nos. 6,444,876; 6,426,447; and 6,380,462), high oil production (U.S. Pat. Nos. 6,495,739; 5,608,149; 6,483,008; and 6,476,295), modified fatty acid content (U.S. Pat. Nos. 6,828,475; 6,822,141; 6,770,465; 6,706,950; 6,660,849; 6,596,538; 6,589,767; 6,537,750; 6,489,461; and 6,459,018), high protein production (U.S. Pat. No. 6,380,466), fruit ripening (U.S. Pat. No. 5,512,466), enhanced animal and human nutrition (U.S. Pat. Nos. 6,723,837; 6,653,530; 6,5412,59; 5,985,605; and 6,171,640), biopolymers (US Pat. Nos. RE37,543; 6,228,623; 5,958,745; and 6,946,588), environmental stress resistance (U.S. Pat. No. 6,072,103), pharmaceutical peptides and secretable peptides (U.S. Pat. Nos. 6,812,379; 6,774,283; 6,140,075; and 6,080,560), improved processing traits (U.S. Pat. No. 6,476,295), improved digestibility (U.S. Pat. No. 6,531,648) low raffinose (U.S. Pat. No. 6,166,292), industrial enzyme production (U.S. Pat. No. 5,543,576), improved flavor (U.S. Pat. No. 6,011,199), nitrogen fixation (U.S. Pat. No. 5,229,114), hybrid seed production (U.S. Pat. No. 5,689,041), fiber production (U.S. Pat. Nos. 6,576,818; 6,271,443; 5,981,834; and 5,869,720) and biofuel production (U.S. Pat. No. 5,998,700).

Non-Coding

In another example, the cargo RNA molecule includes a non-coding sequence. Such non-coding sequences include a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; or a long noncoding RNA (lncRNA).

CRISPR Guide RNAs:

In some embodiments, the cargo RNA sequence is a CRISPR guide RNA. CRISPR-associated endonucleases such as Cas9, Cas12 and Cas13 endonucleases are used as genome editing tools in different plants; see, e.g., Wolter et al. (2019) BMC Plant Biol., 19:176-183); Aman et al. (2018) Genome Biol., 19:1-10. CRISPR/Cas9 requires a two-component crRNA:tracrRNA "guide RNA" ("gRNA") that contains a targeting sequence (the "CRISPR RNA" or "crRNA" sequence) and a Cas9 nuclease-recruiting sequence (tracrRNA). Efficient Cas9 gene editing is also achieved with the use of a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing); see, for example, Cong et al. (2013) Science, 339:819-823; Xing et al. (2014) BMC Plant Biol., 14:327-340. Chemically modified sgRNAs have been demonstrated to be effective in genome editing; see, for example, Hendel et al. (2015) Nature Biotechnol., 985-991. Commercial manufacturers of CRISPR nucleases and guide RNAs provide algorithms for designing guide RNA sequences; see, e.g., guide design tools provided by Integrated DNA Technologies at www[dot]idtdna[dot]com/pages/products/crispr-genome-editing/alt-r-crispr-cas9-system. Some Cas nucleases, including Cas12a and Cas13, do not require a tracrRNA.

For many Cas nucleases, guide sequence designs are constrained by the requirement that the DNA target sequence (to which the crRNA is designed to be complementary) must be adjacent to a proto-spacer adjacent motif ("PAM") sequence that is recognized by the specific Cas nuclease to be employed. Cas nucleases recognize specific PAM sequences and there is a diversity of nucleases and corresponding PAM sequences; see, e.g., Smakov et al. (2017) Nature Reviews Microbiol., doi:10.1038/nrmicro.2016.184. For example, Cas9 nucleases cleave dsDNA, require a GC-rich PAM sequence located 3' to the DNA target sequence to be targeted by the crRNA component of the guide RNA, and cleave leaving blunt ends. Cas12a nucleases cleave dsDNA, require a T-rich PAM sequence located 5' to the DNA target sequence to be targeted by the crRNA component of the guide RNA, and cleave leaving staggered ends with a 5' overhang. Cas13 nucleases cleave single-stranded RNAs and do not require a PAM sequence; instead, Cas13 nuclease are guided to their targets by a single crRNA with a direct repeat ("DR"). In practice, the crRNA component of a guide RNA is generally designed to have a length of between 17-24 nucleotides (frequently 19, 20, or 21 nucleotides) and exact complementarity (i.e., perfect base-pairing) to the targeted gene or nucleic acid sequence that is itself adjacent to a PAM motif (when required by the Cas nuclease). A crRNA component having less than 100% complementarity to the target sequence can be used (e.g., a crRNA with a length of 20 nucleotides and between 1-4 mismatches to the target sequence) but this increases the potential for off-target effects.

Non-limiting examples of effective guide design are found, e.g., in US Patent Application Publications US 2019/0032131, 2015/0082478, and 2019/0352655, which are incorporated by reference in their entirety herein. For the purposes of gene editing, CRISPR "arrays" can be designed to include one or multiple guide RNA sequences corresponding to one or more desired target DNA sequence(s); see, for example, Cong et al. (2013) Science, 339:819-823; Ran et al. (2013) Nature Protocols, 8:2281-2308.

In an embodiment, a cargo RNA sequence that is integrated into a polynucleotide includes at least one CRISPR guide RNA; release of the guide RNA is mediated, e.g., by flanking DR sequences, ribozyme sequences, or other self-cleaving RNAs, or by cleavage by an endogenous ribonuclease. The corresponding Cas nuclease can be provided by separate or concurrent delivery, e.g., by co-delivery with a vector or polynucleotide, or by transient or stable expression of the corresponding Cas nuclease in the cell to which the polynucleotide is delivered.

Selectable or Scorable Markers

In some embodiments, a cargo RNA sequence comprises a selectable or scorable marker. In certain embodiments, the selectable marker or scorable marker is an RNA sequence encoding a polypeptide. Examples of selectable markers include those that confer resistance to a selection agent such as to herbicides or antibiotics. Examples of selectable marker/selection agent combinations include glyphosate-resistant EPSPS enzymes and/or glyphosate oxidases/glyphosate, a bialaphos resistance (bar) or phosphinothricin acyl transferase (pat) enzyme/glufosinate, or a neomycin phosphotransferase (npt)/neomycin or kanamycin. Examples of scorable markers include β-glucuronidase (GUS), luciferase, and fluorescent proteins such as green fluorescent protein (GFP), yellow fluorescent protein (YFP), and cyan fluorescent protein (CFP). In certain embodiments, the selectable or scorable marker is an RNA aptamer or a regulatory RNA, such as an siRNA or siRNA precursor (see, e.g., U.S. Pat. Nos. 8,404,927, 8,455,716, 9,777,288, 10,378,012), a miRNA or a miRNA precursor (see, e.g., U.S. Pat. Nos. 8,410,334, 8,395,023, 9,708,620), a trans-acting siRNA or trans-acting siRNA precursor (see, e.g., U.S. Pat. Nos. 8,030,473, 8,476,422, 8,816,061, 9,018,002), a phased sRNA or phased sRNA precursor (see, e.g., U.S. Pat. No. 8,404,928), an siRNA or miRNA decoy (see, e.g., U.S. Pat. Nos. 8,946,511, 9,873,888), an siRNA or miRNA cleavage blocker (see, e.g., U.S. Pat. No. 9,040,774), an siRNA or miRNA recognition and cleavage sequence (see, e.g., U.S. Pat. Nos. 8,334,430, 9,139,838, 9,976,152, 10,793,869, 10,876,126), a riboswitch, or a ribozyme. Suitable RNA aptamers include those that exhibit fluorescence upon binding a molecule. For example, the fluorescent RNA aptamer can be the Broccoli RNA aptamer. Other fluorescent RNA aptamers that can be used include, but are not limited to, Spinach, Spinach2, Carrot, Radish, Corn, Red Broccoli, Orange Broccoli, and Broccoli Fluorets. Suitable regulatory RNAs can be used to down-regulate (i.e., silence) the expression of a marker gene. For example, phytoene desaturase (PDS) is widely used as a marker gene because silencing of the gene yields a photobleached phenotype. Regulatory RNAs such as decoys or cleavage blockers can also be used to interfere with endogenous small RNA-regulated pathways, resulting in a visible phenotype; see, e.g., U.S. Pat. Nos. 8,946,511, 9,873,888, 9,040,774).

In view of the above several embodiments are noted. In various embodiments of the recombinant DNA molecule, the 5' replicase recognition sequence includes a 5' UTR sequence of the endornavirus. In embodiments, the 5' replicase recognition sequence further includes a genomic sequence of the endornavirus that is natively located 3' to and adjacent to the 5' UTR sequence. In embodiments, the 3' replicase recognition sequence includes a 3' UTR sequence of the endornavirus. In embodiments, the 3' replicase recognition sequence further includes a genomic sequence of the endornavirus that is natively located 5' to and adjacent to the 3' UTR sequence.

In other embodiments, the RNA molecule further includes at least one RNA sequence encoding a viral MP, and wherein the at least one RNA sequence encoding an MP is located (a) before the cargo RNA sequence, (b) after the cargo RNA sequence, or (c) both before and after the cargo RNA sequence.

In embodiments, the at least one RNA sequence encoding an MP includes at least two RNA sequences encoding different MPs or a single RNA sequence encoding multiple copies of MPs.

In some embodiments, the recombinant DNA molecule further includes a discrete expression cassette including a second promoter that is functional in the cell and is operably linked to a DNA sequence encoding at least one viral movement protein, and optionally a terminator element.

In some embodiments, the RNA molecule further includes an ERS, where the ERS is located close to or adjacent to the 3' replicase recognition sequence, and optionally wherein the 3' replicase recognition sequence includes a 3' UTR sequence of the endornavirus. In embodiments, the ERS includes a viral OAS such as a tobacco mosaic virus OAS (TMV-OAS).

In embodiments, the RNA molecule further includes at least one tRNA-like sequence, and wherein the at least one tRNA-like sequence includes a tRNA-like sequence from an *Arabidopsis* FT mRNA. In still other embodiments, the RNA molecule further includes at least one RNA encoding a viral MP, a tRNA-like sequence from an *Arabidopsis* FT mRNA, and an encapsidation recognition sequence including TMV-OAS.

In some embodiments, the cargo RNA sequence is up to about 14 kb in length. In embodiments, the cargo RNA sequence includes: (a) at least one coding sequence, (b) at least one non-coding sequence, or (c) both at least one coding sequence and at least one non-coding sequence. In other embodiments, the cargo RNA sequence includes at least one coding sequence, and wherein the RNA molecule further includes an internal ribosome entry site (IRES) located 5' and immediately adjacent to the at least one coding sequence. In other embodiments, the cargo RNA sequence includes multiple coding sequences, and wherein the RNA molecule further includes an IRES located 5' and immediately adjacent to each of the coding sequences.

In other embodiments, the cargo RNA sequence includes at least one non-coding sequence, and wherein the at least one non-coding sequence is selected from the group consisting of a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; and a long noncoding RNA (lncRNA).

In yet other embodiments, a DNA sequence encoding at least one self-cleaving ribozyme is provided. In embodiments, the at least one self-cleaving ribozyme is located 5' to the 5' replicase recognition sequence or 3' to the 3' replicase recognition sequence. In embodiments, a DNA sequence encoding at least one ligand-responsive self-cleaving ribozyme (aptazyme) is provided. In embodiments, the at least one ligand-responsive self-cleaving ribozyme is located 5' to the 5' replicase recognition sequence or 3' to the 3' replicase recognition sequence.

RNA Molecules

In another aspect, this disclosure is related to RNA molecules produced by expressing a recombinant DNA molecule disclosed herein and which, if desired, are purified and isolated using conventional methods such as those described in the Examples. In embodiments, the RNA molecules are synthetic endornaviral satellite RNAs.

In still another aspect, this disclosure is related to a recombinant RNA molecule which includes, in 5' to 3' order: (a) a 5' replicase recognition sequence that is capable of being recognized by an endornaviral RDRP; (b) a cargo RNA sequence; and (c) a 3' replicase recognition sequence that is capable of being recognized by the endornaviral RDRP; and, optionally, that further comprises at least one additional element selected from the group consisting of: (d) at least one RNA encoding a viral movement protein E (e) at least one tRNA-like sequence; and (f) an OAS. In embodiments, the cargo RNA is heterologous to the 5' replicase recognition sequence and/or is heterologous to the 3' replicase recognition sequence.

In embodiments, the recombinant RNA molecule includes (a) the 5' replicase recognition sequence comprises at least one secondary structure provided in Table 8, 9, or 10; and/or (b) the 3' replicase recognition sequence comprises at least one secondary structure provided in Table 11, 12, or 13. In other embodiments, (a) the 5' replicase recognition sequence comprises an RNA sequence encoded by at least one of SEQ ID Nos: 1-19, 372-405, 465, or 483-485, or the RNA sequence of SEQ ID NO:580, or an RNA sequence having at least 80%, 85%, 90%, 95%, 97%, 98%, or 99% sequence identity thereto, optionally wherein the RNA further comprises at least one secondary structure provided in Table 8, 9, or 10; and/or (b) the 3' replicase recognition sequence comprises an RNA sequence encoded by at least one of SEQ ID Nos: 20-38, 406-454, 467, or 486-488, or the RNA sequence of SEQ ID NO: 581, or an RNA molecule having at least 80%, 85%, 90%, 95%, 97%, 98%, or 99% sequence identity thereto, optionally wherein the RNA further comprises at least one secondary structure provided in Table 11, 12, or 13. In other embodiments, (a) the 5' replicase recognition sequence is derived from an endornavirus; and/or (b) the 3' replicase recognition sequence is derived from an endornavirus. In yet other embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus. In embodiments, the 5' replicase recognition sequence and/or the 3' replicase recognition sequence comprises a 5' replicase recognition sequence and/or a 3' replicase recognition sequence set forth in Table 1.

In still other embodiments, the 5' replicase recognition sequence includes a 5' UTR sequence of the endornavirus. In such embodiments, the 5' replicase recognition sequence further includes a genomic sequence of the endornavirus that is natively located 3' to and adjacent to the 5' UTR sequence. In other embodiments, the 3' replicase recognition sequence includes a 3' UTR sequence of the endornavirus. And in yet other embodiments, the 3' replicase recognition sequence further includes a genomic sequence of the endornavirus that is natively located 5' to and adjacent to the 3' UTR sequence.

In embodiments, the recombinant RNA molecule or synthetic endornavirus satellite RNA is encapsidated by a viral coat protein. When provided, the viral coat protein is heterologous to the endornavirus.

Expression Systems

This disclosure is related to a variety of expression systems including cell-free and cell-based expression systems.

In one aspect, this disclosure is related to a cell-free expression system which includes (a) an RNA molecule comprising, in 5' to 3' order: (i) a 5' replicase recognition sequence derived from an endornavirus; (ii) a cargo RNA sequence; and (iii) a 3' replicase recognition sequence derived from the endornavirus; and, optionally, further comprising at least one additional element selected from the group consisting of: (iv) at least one RNA encoding a viral MP; (v) at least one tRNA-like sequence; and (vi) an OAS; and (b) an RDRP protein that recognizes the 5' and 3' replicase recognition sequences from an endornavirus. In some embodiments, the RDRP protein is provided by the endornavirus.

In another aspect, an expression system is provided which is a cell-based expression system which features (a) a recombinant DNA molecule including a heterologous promoter that is functional in a cell and is operably linked to a DNA sequence encoding an RNA molecule comprising, in 5' to 3' order: (i) a 5' replicase recognition sequence that is capable of being recognized by an endornaviral RDRP; (ii) a cargo RNA sequence; and (iii) a 3' replicase recognition sequence that is capable of being recognized by the endornaviral RDRP; and, optionally, further including (iv) at least one additional element selected from the group consisting of: at least one RNA encoding a viral movement protein (MP); (v) at least one tRNA-like sequence; and (vi) an encapsidation recognition sequence; and (b) a cell containing an RDRP protein that recognizes 5' and 3' replicase recognition sequences derived from an endornavirus. In embodiments, the cell-based expression system is a complete self-replicating endornaviral satellite system that is introduced into a cell (e.g., a plant cell or a fungal cell), wherein the self-replicating endornaviral satellite system comprises: (1) a recombinant endornaviral satellite RNA comprising, in 5' to 3' order: (a) a 5' replicase recognition sequence that is capable of being recognized by an endornaviral RNA-dependent RNA polymerase (RDRP); (b) a cargo RNA sequence; and (c) a 3' replicase recognition sequence that is capable of being recognized by the endornaviral RDRP; wherein the recombinant endornaviral satellite RNA optionally further includes at least one additional element selected from the group consisting of: (d) at least one RNA encoding a viral movement protein (MP); (e) at least one tRNA-like sequence (TLS); and (f) an encapsidation recognition sequence (ERS); and (2) an exogenous endornavirus (e.g., an endornavirus that is not endemic or native to the cell) that is capable of replication in the cell and that encodes the endornaviral RDRP that recognizes the 5' and 3' replicase recognition sequences in the recombinant endornaviral satellite RNA.

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% (e.g., at least 80%, at least 85%, at least 90%, at least 95%, or at least 98%) sequence identity to at least one secondary structure provided in Table 8, 9, or 10.

In yet other embodiments, the 3' replicase recognition sequence includes a sequence having at least 80% (e.g., at least 80%, at least 85%, at least 90%, at least 95%, or at least 98%) sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes at least one of an RNA sequence encoded by SEQ ID Nos:1-19, 372-405, 465, or 483-485, or the RNA sequence of SEQ ID NO:580; and/or the 3' replicase recognition sequence includes at least one of an RNA sequence encoded by SEQ ID Nos: 20-38, 406-454, 467, 486-488, or the RNA sequence of SEQ ID NO:581. In other embodiments, the 5' replicase recognition sequence includes an RNA sequence having at least 80% (e.g., at least 80%, at least 85%, at least 90%, at least 95%, or at least 98%) sequence identity to at least one of an RNA sequence encoded by SEQ ID Nos: 1-19, 372-405, 465, or 483-485, or to the RNA sequence of SEQ ID NO: 580; and/or the 3' replicase recognition sequence includes a sequence having at least 80% (e.g., at least 80%, at least 85%, at least 90%, at least 95%, or at least 98%) sequence identity to at least one of an RNA sequence encoded by SEQ ID Nos: 20-38, 406-454, 467, or 486-488, or to the RNA sequence of SEQ ID NO: 580.

In still other embodiments, the 5' replicase recognition sequence and the 3' replicase recognition sequence are derived from the same endornavirus. In some embodiments, the 5' replicase recognition sequence, the 3' replicase recognition sequence, and the endornaviral RNA-dependent RNA polymerase are all derived from the same endornavirus.

Typically, the cell used in the expression system is a bacterial cell, a plant cell, a fungal cell, or an animal cell.

In some embodiments, the expression system further includes a viral coat protein that is recognized by the encapsidation recognition sequence and encapsidates the RNA molecule.

In some embodiments, the viral coat protein is: (a) expressed by the recombinant DNA molecule in the cell (e.g., where the recombinant DNA molecule further includes a discrete expression cassette comprising a second promoter operably linked to a DNA sequence encoding the viral coat protein, and optionally a terminator element), (b) co-expressed by a second recombinant DNA molecule in the cell; (c) provided exogenously to the cell; or (d) expressed by a virus in the cell. In embodiments, the RDRP protein is heterologous to the cell. In embodiments, the RDRP protein is provided exogenously to the cell.

In some embodiments, the RDRP protein that recognizes the 5' and 3' replicase recognition sequences is endogenously expressed in the plant cell by the endornavirus (e.g., where the endornavirus occurs naturally in the plant cell). In embodiments, the endornavirus is native to or endemic to the plant cell. In embodiments, the endornavirus that is endemic to the plant cell is non-pathogenic. In embodiments, the endornavirus that is endemic to the plant cell is non-pathogenic and commensal. In embodiments, the endornavirus is provided exogenously to the plant cell. In embodiments, the 5' and 3' replicase recognition sequences are recognized by an RDRP protein from an endornavirus that is natively found in a different plant species and that is introduced as an exogenous endornavirus to the plant cell.

In still other embodiments, the recombinant DNA molecule further includes at least one RNA encoding a viral MP, a tRNA-like sequence from an *Arabidopsis* FT mRNA, and an encapsidation recognition sequence including a TMV-OAS.

Exemplary expressions systems are described in the Examples. Vectors useful in various expression systems are described in Table 7.

Cells

In another aspect, this disclosure is related to a cell including any of the aforementioned polynucleotides, recombinant DNA molecules, RNA polynucleotides as well as those molecules described in the Examples. Exemplary cells are prokaryotic (e.g., a bacterium, such as a bacterium capable of transforming a eukaryotic cell (e.g., *Agrobacterium* spp., *Rhizobacterium* spp.)) or eukaryotic (e.g., a plant cell, fungal cell, or animal cell such as an insect cell). In certain embodiments, the cells are bacterial cells capable of transforming a plant cell (e.g., an *Agrobacterium* sp., a *Sinorhizobium* sp., a *Mesorhizobium* sp., *Bradyrhizobium* sp., *Rhizobium* sp., or an Ensifer sp. cell. Bacterial cells capable of transforming a plant cell suitable for use with the recombinant polynucleotides provided herein include *Agrobacterium* sp., a *Sinorhizobium* sp., a *Mesorhizobium* sp., *Bradyrhizobium* sp., *Rhizobium* sp., or an Ensifer sp. cell are disclosed in US patent application publications US20170369898 and US20180312854, each incorporated herein by reference in their entireties.

Vectors

In another aspect, this disclosure is related to a vector for bacterially mediated plant transformation. Such vectors include any of the including any of the aforementioned polynucleotides, recombinant DNA molecules, RNA polynucleotides as well as those molecules described in the Examples. In some embodiments, the bacterium that mediates the plant transformation is an *Agrobacterium* sp., a *Sinorhizobium* sp., a *Mesorhizobium* sp., *Bradyrhizobium* sp., *Rhizobium* sp., or an Ensifer sp. In embodiments where an *Agrobacterium* sp. is used, the vector includes T-DNAs flanking the recombinant DNA molecule encoding the recombinant RNA molecule (e.g., as described in US patent application publications US20170369898 and US20180312854, each incorporated herein by reference in their entireties). In some embodiments, the vector is contained within a plant cell or within a bacterial cell (*Agrobacterium* sp., a *Sinorhizobium* sp., a *Mesorhizobium* sp., *Bradyrhizobium* sp., *Rhizobium* sp., or an Ensifer sp. cell).

Viral Particles

In another aspect, this disclosure is related to viral particles including any of the aforementioned polynucleotides, recombinant DNA molecules, RNA polynucleotides as well as those molecules described in the Examples. In embodiments, the viral particles include any of the expression cassettes described herein including those having at least 80% (e.g., at least 80%, at least 85%, at least 90%, at least 95%, or at least 98%) sequence identity to RNAs encoded by an expression cassette found in Constructs 1-11 (Table 7).

In one embodiment, FIG. 2 shows infiltration of a host or production plant using *Agrobacterium*-mediated transformation with a polynucleotide expressing (5' to 3') a viral coat protein, endornaviral 5' and 3' recognition sequences positioned within appropriate UTRs, a cargo RNA sequence, movement protein, and tRNA-like sequence. Heterologous promoters independently drive expression of the coat protein and the cargo as depicted. The RNA expressed from the polynucleotide includes a TMV-OAS. A host plant is transformed for production of the synthetic endornaviral satellite RNA. The expressed endornaviral satellite RNA is subsequently isolated from leaf material or other tissue of the host plant, purified (and, if desired, formulated) for high pressure spraying onto plants that endogenously contain the corresponding or cognate endornavirus for subsequent expression and replication of the endornaviral satellite, e.g., to modify the plant as desired. Presence of movement protein and t-RNA like sequences facilitates systemic movement throughout the plant receiving the high-pressure spray viral particles.

Plants, Plant Cells, and Plant Propagules

Target plants and plant cells used as hosts for synthetic endornaviral satellite RNAs (e.g., recombinant RNAs) provided herein include both monocot and dicot plants and plant cells which can support endornavirus replication and include row crop plants, fruit-producing plants and trees, vegetables, trees, and ornamental plants including ornamental flowers, shrubs, trees, groundcovers, and turf grasses. In certain embodiments, the plant or plant cell is of the family Asteraceae, Cucurbitaceae, Fabaceae, Lauraceae, Poaceae, or Solanaceae. In certain embodiments, the plant or plant cell is a member of the genus *Capsicum, Cucumis, Cucurbita, Helianthus, Hordeum, Nicotiana, Oryza, Secale, Solanum*, or *Triticum*. In certain embodiments, the target plants and plant cells hosts for synthetic endornaviral satellite RNAs include avocado (*Persea americana*), barley (*Hor-* deum vulgare), broad bean (Viciafaba), buckwheat (*Fagopyrum esculentum*), calabash (*Lagenaria siceraria*), common bean (*Phaseolus vulgaris*), cucumber (*Cucumis sativus*), guar (*Cyamopsis tetragonoloba*), Malabar spinach (*Basella alba*), melon (*Cucumis melo*), pepper (*Capsicum frutescens, Capsicum annuum*), potato (*Solanum tuberosum*), pumpkin (*Cucurbita pepo*), rice (*Oryza sativa, Oryza rufipogon*), rye (*Secale cereale*), sunflower (*Helianthus annuus*), tomato (*Solanum lycopersicum*), wax gourd (*Benincasa hispida*), wheat (*Triticum aestivum*), winged bean (*Psophocarpus tetragonolobus*), and yerba mate (*Ilex paraguariensis*) plants and plant cells. In certain embodiments, target plants and plant cells used as hosts for synthetic endornaviral satellite RNAs (e.g., recombinant RNAs) provided herein include avocado (*Persea americana*), barley (*Hordeum vulgare*), broad bean (*Vicia faba*), buckwheat (*Fagopyrum esculentum*), calabash (*Lagenaria siceraria*), common bean (*Phaseolus vulgaris*), cucumber (*Cucumis sativus*), guar (*Cyamopsis tetragonoloba*), Malabar spinach (*Basella alba*), melon (*Cucumis melo*), pepper (*Capsicum frutescens, Capsicum annuum*), potato (*Solanum tuberosum*), pumpkin (*Cucurbita pepo*), rice (*Oryza sativa, Oryza rufipogon*), rye (*Secale cereale*), sunflower (*Helianthus annuus*), tomato (*Solanum lycopersicum*), wax gourd (*Benincasa hispida*), wheat (*Triticum aestivum*), winged bean (*Psophocarpus tetragonolobus*), and yerba mate (*Ilex paraguariensis*) plants and plant cells.

In another aspect, plant propagules comprising any of the aforementioned or otherwise disclosed polynucleotides, recombinant DNA molecules, and/or recombinant RNA polynucleotides including those molecules described in the Examples are provided. Such plant propagules can comprise a plant cell comprising the polynucleotides, recombinant DNA molecules, and/or recombinant RNA polynucleotides or a seed, seedling, ovule, embryo, pollen, root, stem, leaf, shoot, tuber, rhizome, stolon, bulb, explant, or callus comprising the plant cell comprising the polynucleotides, recombinant DNA molecules, and/or recombinant RNA polynucleotides. In certain embodiments, the plant propagule is a mosaic comprising both plant cells comprising the polynucleotide, the recombinant DNA molecule, or the recombinant RNA molecule and plant cells lacking the polynucleotide, the recombinant DNA molecule, and/or the recombinant RNA molecule. In certain embodiments, at least 99%, 98%, 95%, 90%, 85%, 80%, 70%, 60%, 50%, 40%, 30%, 20%, 10%, 5%, or 1% of the plant cells in the mosaic can comprise the polynucleotide, the recombinant DNA molecule, or the recombinant RNA molecule. In certain embodiments, the plant propagule is a mosaic comprising both plant cells comprising the endornaviral RDRP and plant cells lacking the endornaviral RDRP. In certain embodiments that are particularly advantageous for at least regulatory reasons, the plant propagule lacks DNA that encodes the recombinant RNA molecule.

Methods

In various aspects, this disclosure is related to several useful methods including (i) providing a synthetic endornaviral satellite RNA to a plant cell, (ii) obtaining a phenotypic change in a plant or plant cell; (iii) increasing a plant's resistance and/or tolerance of a pest or pathogen, (iv) increasing a plant's resistance to stress, (v) expressing a polypeptide in a plant or plant cell, (vi) manufacturing a synthetic endornaviral virus particle, (vii) producing a modified plant propagule, (viii) providing a synthetic endornaviral satellite RNA to a plant through grafting, (ix) producing a grafted plant, (x) producing a plant that transmits a recombinant RNA molecule to progeny plants or seed, (xi) barcoding a plant, plant cell, progeny thereof, or part thereof, and (xii) identifying a barcoded plant, plant part, or plant cell. Further aspects of this disclosure are related to the plants having the phenotypic change, increased resistance or tolerance to pests, pathogens, or stress; the modified plant propagules, the grafted plants; the progeny plants or seed; the barcoded plant, plant part, or plant cell; and kits for identifying such a barcoded plant, plant part, or plant cell.

In certain embodiments, the methods can further comprise (a) providing a population of plants comprising the plant cells comprising: (i) the endornavirus which provides the RDRP; or (ii) a recombinant polynucleotide molecule that encodes the RDRP; and (b) providing the recombinant RNA molecule (the synthetic endornaviral satellite RNA) to the plants comprising the plant cells. In certain embodiments, the methods can further comprise the step of determining if the plant cell comprises an endornavirus which can provide the RDRP. In embodiments wherein it is determined that the plant cell comprises the endornavirus which can provide the RDRP, the endornavirus, the RDRP protein, and/or the recombinant polynucleotide encoding the RDRP is optionally not exogenously provided to the plant cell. In other embodiments wherein it is determined that the plant cell does not comprise the endornavirus which can provide the RDRP and the endornavirus is exogenously provided to the cell, the RDRP protein or the recombinant polynucleotide encoding the RDRP is exogenously provided to the plant cell, or a combination of the endornavirus, RDRP protein, or polynucleotide encoding the RDRP is exogenously provided to the plant cell. The presence or absence of an endornavirus in a target plant can be determined by assays which can detect the endornaviral RNA or endornaviral protein; similar assays can be used to determine the presence or absence of a synthetic endornaviral satellite RNA (or a component thereof, e.g., the cargo RNA) in a target plant or cell. Assays for detection of endornaviral RNA include RNA detection assays (e.g., an RT-PCR assay) using nucleic acid probes and/or primers which can detect any part of an endornavirus genome including a 5' RNA replicase recognition sequence, an RDRP coding region, and/or a 3' RNA replicase recognition sequence. Such probes and primers include those which detect any of the 5' or 3' RNA replicase recognition sequences set forth in Table 1 or having significant sequence identity thereto (e.g., at least about 80%, 85%, 90%, 95%, 98%, or 99% sequence identity over a length of at least about 18, 20, 30, 40, or 50 nt). The presence or absence of an endornavirus in a target plant can be determined by a protein detection assay (e.g., an immunoassay) directed to an endornaviral RDRP (e.g., an RDRP encoded by or homologous to an RDRP encoded by an endornaviral genome disclosed in Table 1). Assays which can detect an endornaviral protein (e.g., an RDRP encoded by or homologous to an RDRP encoded by an endornaviral genome disclosed in Table 1) include immunodetection and/or mass-spectroscopy based assays. Target plants and plant cells used in the methods include all aforementioned target plants and plant cell hosts for synthetic endornaviral satellite RNAs (e.g., recombinant RNAs). In certain embodiments, the target plants and plant cell hosts used in the methods include avocado (*Persea americana*), barley (*Hordeum vulgare*), broad bean (Viciafaba), calabash (*Lagenaria siceraria*), common bean (*Phaseolus vulgaris*), guar (*Cyamopsis tetragonoloba*), Malabar spinach (*Basella alba*), melon (*Cucumis melo*), pepper (Capsicumfrutescens, *Capsicum annuum*), rice (*Oryza sativa, Oryza rufipogon*), sunflower (*Helianthus

*annuus*), wax gourd (*Benincasa hispida*), winged bean (*Psophocarpus tetragonolobus*), and yerba mate (*Ilex paraguariensis*) plants.

i. Providing a Synthetic Endornaviral Satellite RNA to a Plant Cell

In one aspect, this disclosure is related to a method of providing a synthetic endornaviral satellite RNA to a plant cell. The method, in general, features the steps including providing to a plant cell a recombinant RNA molecule (a copy of, or a template for, the "synthetic endornaviral satellite RNA") including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant cell includes an RDRP protein that recognizes the 5' replicase recognition sequence and 3' replicase recognition sequence, whereby the RDRP protein catalyzes synthesis of synthetic endornaviral satellite RNAs (i.e., further copies of the recombinant RNA molecule) from the recombinant RNA molecule.

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% sequence identity to at least one secondary structure provided in Table 8, 9, or 10. In yet other embodiments, the 3' replicase recognition sequence includes a sequence having at least 80% sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes at least one of an RNA sequence encoded by a DNA sequence of SEQ ID Nos:1-19, 372-405, 465, or 483-485, or the RNA sequence of SEQ ID NO:580; and/or the 3' replicase recognition sequence includes at least one of an RNA sequence encoded by a DNA sequence of SEQ ID Nos:20-38, 406-454, 467, or 486-488, or the RNA sequence of SEQ ID NO:581. In other embodiments, the 5' replicase recognition sequence includes a sequence having at least 80% sequence identity to at least one of an RNA sequence encoded by a DNA sequence of SEQ ID Nos: 1-19, 372-405, 465, or 483-485, or to the RNA sequence of SEQ ID NO:580; and/or the 3' replicase recognition sequence includes a sequence having at least 80% sequence identity to at least one of an RNA sequence encoded by a DNA sequence of SEQ ID Nos: 20-38, 406-454, 467, or 486-488, or to the RNA sequence of SEQ ID NO:581.

In some embodiments, the 5' replicase recognition sequence is derived from an endornavirus; and/or the 3' replicase recognition sequence is derived from an endornavirus. Typically, the 5' replicase recognition sequence and the 3' replicase recognition sequence are derived from the same endornavirus. In other embodiments, the 5' replicase recognition sequence and the 3' replicase recognition sequence are derived from different endornaviruses.

In other embodiments, the plant cell includes the endornavirus, and the RDRP protein is provided to the plant cell by the endornavirus. In embodiments, the endornavirus is endemic to the plant cell. In embodiments, the endornavirus that is endemic to the plant cell is non-pathogenic and/or commensal to the plant cell. In other embodiments, the endornavirus is exogenously provided to the plant cell.

In some embodiments, the RDRP protein is exogenously provided to the plant cell, e.g., by transgenic expression of the RDRP protein in the plant cell. In embodiments, the RDRP protein is exogenously provided to the plant cell by introducing into the plant cell an exogenous endornavirus, e.g., an endornavirus that is natively found in a different organism, species, variety, or germplasm, and that is capable of self-replication when introduced into the plant cell.

In some embodiments, the recombinant RNA molecule is produced in a fermentation system.

In yet other embodiments, the synthetic endornaviral satellite RNA is provided to the plant cell by transcribing in the plant cell a recombinant DNA construct including a promoter functional in the plant cell and operably linked to a DNA sequence encoding the recombinant RNA molecule.

In embodiments, the recombinant RNA molecule further includes an encapsidation recognition sequence, and wherein the plant cell further includes a viral coat protein capable of encapsidating the synthetic endornaviral satellite RNA. In embodiments, the viral coat protein is exogenously provided to the plant cell.

In other embodiments, an encapsidation recognition sequence near the 3' end of the RNA molecule is TMV-OAS, which is recognized by the TMV coat protein, leading to assembly of the encapsidated RNA.

In embodiments, viral coat protein can be provided, e.g., by co-expression of a recombinant construct encoding the viral coat protein; or by native expression by a virus endogenous to or introduced into the plant cell.

In other embodiments, the recombinant DNA construct further includes a DNA sequence encoding a viral coat protein. In embodiments, the recombinant DNA construct further includes a second promoter functional in the plant cell and operably linked to the DNA sequence encoding the viral plant protein. In yet other embodiments, the viral coat protein is expressed in the plant cell and encapsidates the synthetic endornaviral satellite RNA.

In embodiments, the plant cell includes the endornavirus, and the endornavirus provides the plant cell the RDRP protein.

ii. Obtaining a Phenotypic Change in a Plant or Plant Cell

In another aspect, this disclosure is related to a method of obtaining a phenotypic change in a plant or plant cell, The method, in general, includes the steps of: providing to a plant or plant cell a recombinant RNA molecule including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the cargo RNA sequence includes RNA that effects (directly or indirectly) a phenotypic change in the plant or plant cell; wherein the plant or plant cell includes an RDRP protein that recognizes the 5' replicase recognition sequence and 3' replicase recognition sequence, whereby the RDRP protein catalyzes synthesis of a synthetic endornaviral satellite RNA from the recombinant RNA molecule and the cargo RNA sequence effects the phenotypic change.

In embodiments, the recombinant RNA molecule is provided directly to the plant or plant cell. In other embodiments, the recombinant RNA molecule is provided by expressing in the plant or plant cell a DNA molecule that encodes the recombinant RNA molecule.

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% sequence identity to at least one secondary structure provided in Table 8, 9, or 10. In yet other embodiments, the 3' replicase recognition sequence includes a sequence having at least 80% sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes an RNA sequence encoded by at least one of SEQ ID Nos: 1-19, 372-405, 465, or 483-485, or the RNA sequence of SEQ ID NO: 580; and/or the 3' replicase recognition sequence includes an RNA sequence encoded by at least one of SEQ ID Nos: 20-38, 406-454, 467, or 486-488, or the RNA sequence of SEQ ID NO:581. In other embodiments, the 5' replicase recognition sequence includes a sequence having at least 80% (e.g., at least 80%, 85%, 90%, 95%, 98%, or 99%) sequence identity to at least one of an RNA sequence encoded by SEQ ID Nos: 1-19, 372-405, 465, or 483-485, or to the RNA sequence of SEQ ID NO: 580; and/or the 3' replicase recognition sequence includes a sequence having at least 80% (e.g., at least 80%, 85%, 90%, 95%, 98%, or 99%) sequence identity to at least one of an RNA sequence encoded by SEQ ID Nos: 20-38, 406-454, 467, 486-488, or to the RNA sequence of SEQ ID NO: 581. In embodiments, the 5' replicase recognition sequence and/or the 3' replicase recognition sequence comprises any of the aforementioned 5' replicase recognition sequences and/or 3' replicase recognition sequences present in recombinant RNA molecules disclosed herein.

In embodiments, the 5' replicase recognition sequence is derived from an endornavirus; and/or the 3' replicase recognition sequence is derived from an endornavirus.

In embodiments, the 5' replicase recognition sequence and the 3' replicase recognition sequence are derived from the same endornavirus.

In other embodiments, the RNA that effects a phenotypic change in the plant or plant cell includes an RNA for modulating a target gene's expression relative to the target gene's expression in a control plant or plant cell not provided with the recombinant RNA molecule, and wherein the phenotypic change is a result of the modulation.

In embodiments, the modulation is (a) an increase of the target gene's expression; or (b) a decrease of the target gene's expression.

In other embodiments, the RNA that effects a phenotypic change in the plant or plant cell suppresses the target gene's expression.

In still other embodiments, the RNA that effects a phenotypic change in the plant or plant cell includes at least one RNA selected from an siRNA or siRNA precursor, a miRNA or miRNA precursor, and a phased siRNA or phased siRNA precursor.

In still other embodiments, the RNA that effects a phenotypic change in the plant or plant cell includes a messenger RNA.

In still other embodiments, the messenger RNA includes an RNA sequence absent in the genome of the plant or plant cell.

In embodiments, the RNA that effects a phenotypic change in the plant or plant cell includes an RNA for modifying the genome of the plant or plant cell (e.g., one or more guide RNAs for CRISPR Cas nuclease editing of the genome.

Typically, the plant cell includes the endornavirus, and the RDRP protein is provided to the plant cell by the endornavirus. In embodiments, the endornavirus is endemic to the plant cell. In other embodiments, the endornavirus is exogenously provided to the plant cell by introducing into the plant cell an exogenous endornavirus, e.g., an endornavirus that is natively found in a different organism, species, variety, or germplasm, and that is capable of self-replication when introduced into the plant cell.

In some embodiments, the RDRP protein is exogenously provided to the plant cell, e.g., by transgenic expression of the RDRP protein in the plant cell.

In yet other embodiments, the recombinant RNA molecule is produced in a fermentation system.

In embodiments, the recombinant RNA molecule is provided to the plant cell by transcribing in the plant cell a recombinant DNA construct including a promoter functional in the plant cell and operably linked to a DNA sequence encoding the recombinant RNA molecule. In embodiments, the recombinant RNA molecule further includes an encapsidation recognition sequence, and the plant cell further includes a viral coat protein capable of encapsidating the synthetic endornaviral satellite RNA.

In embodiments, wherein the viral coat protein is exogenously provided to the plant cell.

In other embodiments, the recombinant DNA construct further includes a DNA sequence encoding a viral coat protein. Still in other embodiments, the recombinant DNA construct further includes a second promoter functional in the plant cell and operably linked to the DNA sequence encoding the viral coat protein. In embodiments, the viral coat protein is expressed in the plant cell and encapsidates the synthetic endornaviral satellite RNA.

In yet other embodiments, the plant cell includes the endornavirus, and the endornavirus provides the plant cell the RDRP protein.

In still other embodiments, the recombinant RNA molecule is provided to the plant cell by contacting the plant cell with a formulation including the recombinant RNA molecule, wherein the recombinant RNA molecule has been produced in a fermentation system, where the recombinant RNA molecule is optionally encapsidated by a viral coat protein.

In embodiments, exemplary phenotypes that are changed include, without limitation, developmental rate, growth rate, size, yield (e.g., intrinsic yield), vigor, photosynthetic capability, flavor, starch production, protein content, carbohydrate content, oil content, fatty acid content, lipid content, digestibility, biomass, shoot length, root length, root architecture, seed set, seed weight, seed quality (e.g., nutritional content), germination, fruit set, rate of fruit ripening, production of biopolymers, production of fibers, production of biofuels, production of pharmaceutical peptides, production of secretable peptides, enzyme production, improved processing traits, or amount of harvestable produce.

In some embodiments, phenotypes include taste, appearance, or shelf-life of a product harvested from the plant. In other embodiments, phenotypes that are changed include flower size, flower color, flower patterning, flower morphology including presence or absence of stamens, flower number, flower longevity, flower fragrance, leaf size, leaf color, leaf patterning, leaf morphology, plant height, or plant architecture.

In embodiments, RNA that effects a phenotypic change in the plant or plant cell includes an RNA for modulating a target gene's expression relative to the target gene's expression in a control plant or plant cell not provided with the recombinant RNA molecule, and wherein the phenotypic change is a result of the modulation.

In some embodiments, the modulation is an increase of the target gene's expression. For example, expression of the target gene is increased by about 1%, 2%, 3%, %, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100%, or more than 100% relative to a reference level (e.g., a level found in a control plant or plant cell not provided with the recombinant molecule).

In certain embodiments, expression of the target gene is increased by up to about 2-, 3-, 4-, 5-, 6-, 8-, 9-, 10-fold, or more relative to a reference level (e.g., a level found in a control plant or plant cell lacking the recombinant RNA molecule).

In some embodiments, the modulation is a decrease of the target gene's expression. For example, expression of the target gene is decreased by about 1%, 2%, 3%, %, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100%, or more than 100% relative to a reference level (e.g., a level found in a control plant or plant cell not provided with the recombinant molecule).

In certain embodiments, expression of the target gene is decreased by up to about 2-, 3-, 4-, 5-, 6-, 8-, 9-, 10-fold, or more relative to a reference level (e.g., a level found in a control plant or plant cell lacking the recombinant RNA molecule).

Modulation of target gene expression can be affected by one or more of an RNA for modifying the genome, the epigenome, and/or transcriptome of the plant or plant cell. RNAs for modifying the genome can include gRNAs recognized by CAS nucleases, RNAs encoding TALENs or artificial zinc finger proteins (aZFN). RNAs for modifying the epigenome can include RNAs which provide RNA directed DNA methylation such as in promoter regions of target genes (Matzke and Mosher (2014). Doi: 10.1038/nrg3683). An RNA for modifying the transcriptome can comprise a hairpin RNA (hpRNA); an RNA that forms multiple stem-loops; an RNA pseudoknot; an RNA molecule that forms at least partially double-stranded RNA; a small interfering RNA (siRNA) or siRNA precursor; a microRNA (miRNA) or miRNA precursor; a ribozyme; a ligand-responsive ribozyme (aptazyme); an RNA aptamer; or a long noncoding RNA (lncRNA).

iii. Increasing a Plant's Resistance and/or Tolerance to a Pest or Pathogen

In still another aspect, this disclosure is related to a method of increasing a plant's resistance and/or tolerance to a pest or pathogen. The method, in general, includes the steps of providing a plant with a recombinant RNA molecule including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the cargo RNA sequence effects (directly or indirectly) an increase in the plant's resistance and/or tolerance to a pest or pathogen, relative to that in a plant not provided with the recombinant RNA molecule, wherein the plant or plant cell includes an RDRP protein that recognizes the 5' replicase recognition sequence and 3' replicase recognition sequence, whereby the RDRP protein catalyzes synthesis of a synthetic endornaviral satellite RNA from the recombinant RNA molecule. As used herein, resistance to a pest or pathogen refers to the ability of the plant to restrict the activities of the pest or pathogen (e.g., pest feeding, pathogen multiplication). As used herein, tolerance to a pest or pathogen refers to the ability of the plant maintain its fitness (e.g., yield) regardless of the presence or load of the pest or pathogen.

In embodiments, the recombinant RNA molecule is provided directly to the plant or plant cell. In other embodiments, the recombinant RNA molecule is provided by expressing in the plant or plant cell a DNA molecule that encodes the recombinant RNA molecule.

In embodiments, the pest or pathogen is selected from the group including: a bacterium, a fungus, an oomycete, and an invertebrate (e.g., an arthropod, a mollusk, or a nematode).

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% sequence identity to at least one secondary structure provided in Table 8, 9, or 10. In yet other embodiments, the 3' replicase recognition sequence includes a sequence having at least 80% sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes at least one of an RNA sequence encoded by SEQ ID Nos: 1-19, 372-405, 465, or 483-485, or the RNA sequence of SEQ ID NO:580; and/or the 3' replicase recognition sequence includes at least one of an RNA sequence encoded by SEQ ID Nos: 20-38, 406-454, 467, or 486-488, or the RNA sequence of SEQ ID NO:581. In other embodiments, the 5' replicase recognition sequence includes a sequence having at least 80% sequence identity to an RNA sequence encoded by at least one of SEQ ID Nos: 1-19, 372-405, 465, or 483-485, or to the RNA sequence of SEQ ID NO: 580; and/or the 3' replicase recognition sequence includes a sequence having at least 80% sequence identity to at least one of SEQ ID Nos:20-38, 406-454, 467, or 486-488 or to the RNA sequence of SEQ ID NO: 581.

In embodiments, the 5' replicase recognition sequence is derived from an endornavirus; and/or the 3' replicase recognition sequence is derived from an endornavirus.

In embodiments, the 5' replicase recognition sequence and the 3' replicase recognition sequence are derived from the same endornavirus.

In other embodiments, the RNA that effects an increase in the plant's resistance and/or tolerance to a pest or pathogen includes an RNA for modulating a target gene's expression relative to the target gene's expression in a control plant or plant cell not provided with the recombinant RNA molecule, and wherein the phenotypic change is a result of the modulation.

In embodiments, the modulation is (a) an increase of the target gene's expression; or (b) a decrease of the target gene's expression.

In other embodiments, the RNA that effects an increase in the plant's resistance and/or tolerance to a pest or pathogen suppresses the target gene's expression.

In still other embodiments, the RNA that effects an increase in the plant's resistance and/or tolerance to a pest or pathogen includes at least one RNA selected from an siRNA or siRNA precursor, a miRNA or miRNA precursor, and a phased siRNA or phased siRNA precursor.

In still other embodiments, the RNA that effects an increase in the plant's resistance and/or tolerance to a pest or pathogen includes a messenger RNA.

In still other embodiments, the messenger RNA includes an RNA sequence absent in the genome of the plant or plant cell.

In embodiments, the RNA that effects an increase in the plant's resistance and/or tolerance to a pest or pathogen includes an RNA for modifying the genome of the plant or plant cell (e.g., one or more guide RNAs for CRISPR Cas nuclease editing of the genome.

Typically, the plant cell includes the endornavirus, and the RDRP protein is provided to the plant cell by the endornavirus. In embodiments, the endornavirus is endemic to the plant cell. In other embodiments, the endornavirus is exogenously provided to the plant cell by introducing into the plant cell an exogenous endornavirus, e.g., an endornavirus that is natively found in a different organism, species, variety, or germplasm, and that is capable of self-replication when introduced into the plant cell. In some embodiments, the RDRP protein is exogenously provided to the plant cell, e.g., by transgenic expression of the RDRP protein in the plant cell.

In yet other embodiments, the recombinant RNA molecule is produced in a fermentation system. In embodiments, the recombinant RNA molecule is provided to the plant cell by transcribing in the plant cell a recombinant DNA construct including a promoter functional in the plant cell and operably linked to a DNA sequence encoding the recombinant RNA molecule. In embodiments, the recombinant RNA molecule further includes an encapsidation recognition sequence, and the plant cell further includes a viral coat protein capable of encapsidating the synthetic endornaviral satellite RNA.

In embodiments, wherein the viral coat protein is exogenously provided to the plant cell.

In other embodiments, the recombinant DNA construct further includes a DNA sequence encoding a viral coat protein. Still in other embodiments, the recombinant DNA construct further includes a second promoter functional in the plant cell and operably linked to the DNA sequence encoding the viral coat protein. In embodiments, the viral coat protein is expressed in the plant cell and encapsidates the synthetic endornaviral satellite RNA.

In yet other embodiments, the plant cell includes the endornavirus, and the endornavirus provides the plant cell the RDRP protein.

In still other embodiments, the recombinant RNA molecule is provided to the plant cell by contacting the plant cell with a formulation including the recombinant RNA molecule, wherein the recombinant RNA molecule has been produced in a fermentation system, where the recombinant RNA molecule is optionally encapsidated by a viral coat protein.

In embodiments, the cargo RNA sequence effects an increase in the plant's resistance and/or tolerance to a pest or pathogen, relative to that in a plant not provided with the recombinant RNA molecule. For example, expression of the RNA sequence increases a plant's resistance and/or tolerance to a pest or pathogen by about 1%, 2%, 3%, %, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100%, or more than 100% relative to a reference level (e.g., a level found in a control plant or plant cell not provided with the recombinant molecule).

In any of the aforementioned or otherwise disclosed methods wherein a plant's resistance and/or tolerance to a pest or pathogen is increased, the recombinant RNA can comprise an RNA that inhibits expression of a gene of the pest or pathogen and/or inhibits replication of the genome of the pest or pathogen. In certain embodiments, the pest or pathogen is selected from the group comprising: a bacterium, a virus other than an endornavirus, a fungus, an oomycete, and an invertebrate (e.g., an arthropod or a nematode). Embodiments of target viruses other than an endornavirus include, but are not limited to; (i) positive-strand RNA viruses in the Virgaviridae, Solemoviridae, Alphaflexiviridae, Bromoviridae, Closteroviridae, Luteoviridae, or Potyviridae family; (ii) negative-strand RNA viruses in the Bunyaviridae and Rhabdoviridae family; (iii) dsDNA viruses in the family Caulimoviridae; and (iii) ssDNA viruses in the family Geminiviridae. Non-limiting embodiments of target invertebrate pests include arthropod pests (e.g., coleopteran, lepidopteran, and dipteran insects, and arachnids such as mites) and nematode pests (e.g., root knot nematodes and cyst-forming nematodes). Non-limiting embodiments of target fungal and oomycete pathogens include *Magnaporthe* spp., *Botrytis* spp., *Puccinia* spp.; *Fusarium* spp., *Blumeria* spp., *Mycosphaerella* spp., *Colletotrichum* spp., *Ustilago* spp., *Melampsora* spp., *Phakopsora* spp., *Phytophthora* spp., and *Rhizoctonia* spp. In embodiments, the cargo RNA molecule effects an increase in the plant's resistance and/or tolerance to a pest or pathogen, relative to that in a plant not provided with the recombinant RNA molecule.

iv. Increasing a Plant's Resistance to Stress

In still another aspect, this disclosure is related to a method of increasing a plant's resistance to stress. The method, in general, includes the steps of: providing a plant with a recombinant RNA molecule including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant or plant cell includes an RDRP protein that recognizes the 5' replicase recognition sequence and 3' replicase recognition sequence, whereby the RDRP protein catalyzes synthesis of the synthetic endornaviral satellite RNA from the recombinant RNA molecule and wherein the cargo RNA sequence effects (directly or indirectly) an increase in the plant's resistance to stress, relative to that in a plant not provided with the recombinant RNA molecule.

In embodiments, the recombinant RNA molecule is provided directly to the plant or plant cell. In other embodiments, the recombinant RNA molecule is provided by expressing in the plant or plant cell a DNA molecule that encodes the recombinant RNA molecule.

In embodiments, the stress includes at least one abiotic stress selected from the group including: nutrient stress, light stress, water stress, heat stress, and cold stress.

In other embodiments, the stress includes at least one biotic stress selected from the group including: crowding, shading, and allelopathy (e.g., resulting from allelopathic chemicals such as juglone produced by walnut trees).

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% sequence identity to at least one secondary structure provided in Table 8, 9, or 10. In yet other embodiments, the 3' replicase recognition sequence includes a sequence having at least 80% sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes an RNA sequence encoded by at least one of SEQ ID Nos: 1-19, 372-405, 465, or 483-485, or the RNA sequence of SEQ ID NO:580; and/or the 3' replicase recognition sequence includes an RNA sequence encoded by at least one of SEQ ID Nos: 20-38, or 406-454, or the RNA sequence of SEQ ID NO:580. In other embodiments, the 5' replicase recognition sequence includes a sequence having at least 80% sequence identity to at least one of an RNA sequence encoded by SEQ ID Nos: 1-19, 372-405, 465, or 483-485, or to the RNA sequence of SEQ ID NO:580; and/or the 3' replicase recognition sequence includes a sequence having at least 80% sequence identity to at least one of an RNA sequence encoded by SEQ ID Nos: 20-38, 406-454, 467, or 486-488, or to the RNA sequence of SEQ ID NO:581. In embodiments, the 5' replicase recognition sequence and/or the 3' replicase recognition sequence comprises any of the aforementioned 5' replicase recognition sequences and/or 3' replicase recognition sequences present in recombinant RNA molecules disclosed herein.

In embodiments, the 5' replicase recognition sequence is derived from an endornavirus; and/or the 3' replicase recognition sequence is derived from an endornavirus.

In embodiments, the 5' replicase recognition sequence and the 3' replicase recognition sequence are derived from the same endornavirus.

In other embodiments, the RNA that effects an increase in the plant's resistance to stress in the plant or plant cell includes an RNA for modulating a target gene's expression relative to the target gene's expression in a control plant or plant cell not provided with the recombinant RNA molecule, and wherein the phenotypic change is a result of the modulation.

In embodiments, the modulation is (a) an increase of the target gene's expression; or (b) a decrease of the target gene's expression.

In other embodiments, the RNA that effects an increase in the plant's resistance to stress in the plant or plant cell suppresses the target gene's expression.

In still other embodiments, the RNA that effects an increase in the plant's resistance to stress in the plant or plant cell includes at least one RNA selected from an siRNA or siRNA precursor, a miRNA or miRNA precursor, and a phased siRNA or phased siRNA precursor.

In still other embodiments, the RNA that effects an increase in the plant's resistance to stress in the plant or plant cell includes a messenger RNA.

In still other embodiments, the messenger RNA includes an RNA sequence absent in the genome of the plant or plant cell.

In embodiments, the RNA that effects an increase in the plant's resistance to stress in the plant or plant cell includes an RNA for modifying the genome of the plant or plant cell (e.g., one or more guide RNAs for CRISPR Cas nuclease editing of the genome.

Typically, the plant cell includes the endornavirus, and the RDRP protein is provided to the plant cell by the endornavirus. In embodiments, the endornavirus is endemic to the plant cell. In embodiments, the endornavirus that is endemic to the plant cell is non-pathogenic and/or commensal to the plant cell. In other embodiments, the endornavirus is exogenously provided to the plant cell by introducing into the plant cell an exogenous endornavirus, e.g., an endornavirus that is natively found in a different organism, species, variety, or germplasm, and that is capable of self-replication when introduced into the plant cell.

In some embodiments, the RDRP protein is exogenously provided to the plant cell, e.g., by transgenic expression of the RDRP protein in the plant cell.

In yet other embodiments, the recombinant RNA molecule is produced in a fermentation system.

In embodiments, the recombinant RNA molecule is provided to the plant cell by transcribing in the plant cell a recombinant DNA construct including a promoter functional in the plant cell and operably linked to a DNA sequence encoding the recombinant RNA molecule. In embodiments, the recombinant RNA molecule further includes an encapsidation recognition sequence, and the plant cell further includes a viral coat protein capable of encapsidating the synthetic endornaviral satellite RNA.

In embodiments, wherein the viral coat protein is exogenously provided to the plant cell.

In other embodiments, the recombinant DNA construct further includes a DNA sequence encoding a viral coat protein. Still in other embodiments, the recombinant DNA construct further includes a second promoter functional in the plant cell and operably linked to the DNA sequence encoding the viral coat protein. In embodiments, the viral coat protein is expressed in the plant cell and encapsidates the synthetic endornaviral satellite RNA.

In yet other embodiments, the plant cell includes the endornavirus, and the endornavirus provides the plant cell the RDRP protein.

In still other embodiments, the recombinant RNA molecule is provided to the plant cell by contacting the plant cell with a formulation including the recombinant RNA molecule, wherein the recombinant RNA molecule has been produced in a fermentation system, where the recombinant RNA molecule is optionally encapsidated by a viral coat protein.

In embodiments, the cargo RNA sequence effects an increase in the plant's resistance to a stress, relative to that in a plant not provided with the recombinant RNA molecule.

For example, expression of the RNA sequence increases a plant's resistance to a stress by about 1%, 2%, 3%, %, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100%, or more than 100% relative to a reference level (e.g., a level found in a control plant or plant cell not provided with the recombinant molecule).

v. Expressing a Polypeptide in a Plant or Plant Cell

In another aspect, this disclosure is related to a method of expressing an exogenous polypeptide (e.g., an exogenous polypeptide) in a plant or plant cell. The method, in general, includes the steps of: expressing in a plant or plant cell a recombinant DNA molecule including a heterologous promoter that is functional in the plant or plant cell and is operably linked to a DNA sequence encoding an RNA molecule that includes, in 5' to 3' order: (a) a 5' replicase recognition sequence that is capable of being recognized by an endornaviral RDRP; (b) a cargo RNA sequence including a translatable messenger RNA encoding an polypeptide; and (c) a 3' replicase recognition sequence that is capable of being recognized by the endornaviral RDRP; wherein the RNA molecule optionally further includes at least one additional element selected from the group consisting of: (d) at least one RNA encoding a viral MP; (e) at least one tRNA-like sequence; and (f) an encapsidation recognition sequence, wherein the plant or plant cell includes an RDRP protein that recognizes the 5' replicase recognition sequence and 3' replicase recognition sequence, whereby the RDRP protein catalyzes synthesis of a synthetic endornaviral satellite RNA from the recombinant RNA molecule and wherein the polypeptide is translated from the translatable messenger RNA encoding a polypeptide.

In embodiments, the recombinant RNA molecule is provided directly to the plant or plant cell. In other embodiments, the recombinant RNA molecule is provided by expressing in the plant or plant cell a DNA molecule that encodes the recombinant RNA molecule.

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% sequence identity to at least one secondary structure provided in Table 8, 9, or 10. In yet other embodiments, the 3' replicase recognition sequence includes a sequence having at least 80% sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes an RNA sequence encoded by at least one of SEQ ID Nos: 1-19, 372-405, 465, or 483-485, or the RNA sequence of SEQ ID NO:580; and/or the 3' replicase recognition sequence includes an RNA sequence encoded by at least one of SEQ ID Nos: 20-38, 406-454, 467, or 486-488, or the RNA sequence of SEQ ID NO:581. In other embodiments, the 5' replicase recognition sequence includes a sequence having at least 80% sequence identity to an RNA sequence encoded by at least one of SEQ ID Nos: 1-19, 372-405, 465, or 483-485, or to the RNA sequence of SEQ ID NO:580; and/or the 3' replicase recognition sequence includes a sequence having at least 80% sequence identity to an RNA sequence encoded by at least one of SEQ ID Nos: 20-38, 406-454, 467, or 486-488, or to the RNA sequence of SEQ ID NO:581. In embodiments, the 5' replicase recognition sequence and/or the 3' replicase recognition sequence comprises any of the aforementioned 5' replicase recognition sequences and/or 3' replicase recognition sequences present in recombinant RNA molecules disclosed herein.

In some embodiments, the 5' replicase recognition sequence is derived from an endornavirus; and/or the 3' replicase recognition sequence is derived from an endornavirus. Typically, the 5' replicase recognition sequence and the 3' replicase recognition sequence are derived from the same endornavirus.

In other embodiments, the 5' replicase recognition sequence and the 3' replicase recognition sequence are derived from different endornaviruses.

In embodiments, the cargo RNA sequence includes at least one coding sequence encoding a polypeptide and is translated to produce the polypeptide in the plant.

In embodiments, the polypeptide is isolated.

In embodiments, the polypeptide is purified.

vi. Manufacturing a Synthetic Endornaviral Satellite Particle

In another aspect, this disclosure is related to a method of manufacturing a synthetic endornaviral satellite particle. The method, in general, includes the steps of: (a) providing to a cell (e.g., a bacterial, yeast, animal or plant cell) a recombinant RNA molecule including, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant cell includes an RDRP protein that recognizes the 5' replicase recognition sequence and 3' replicase recognition sequence, whereby the RDRP protein catalyzes synthesis of a synthetic endornaviral satellite RNA from the recombinant RNA molecule; and (b) encapsidating the synthetic endornaviral satellite RNA with a viral coat protein, thereby providing a synthetic endornaviral satellite particle.

In embodiments, the recombinant RNA molecule is provided directly to the cell, for example, the plant or plant cell. In other embodiments, the recombinant RNA molecule is provided by expressing in cell, for example, the plant or plant cell a DNA molecule that encodes the recombinant RNA molecule.

In embodiments, the 5' replicase recognition sequence includes at least one secondary structure provided in Table 8, 9, or 10; and/or the 3' replicase recognition sequence includes at least one secondary structure provided in Table 11, 12, or 13. In other embodiments, the 5' replicase recognition sequence includes a sequence having at least 80% sequence identity to at least one secondary structure provided in Table 8, 9, or 10. In yet other embodiments, the 3' replicase recognition sequence includes a sequence having at least 80% sequence identity to at least one secondary structure provided in Table 8, 9, or 10.

In embodiments, the 5' replicase recognition sequence and/or the 3' replicase recognition sequence comprises a 5' replicase recognition sequence and/or a 3' replicase recognition sequence set forth in Table 1. In embodiments, the 5' replicase recognition sequence includes an RNA sequence encoded by at least one of SEQ ID Nos: 1-19, 372-405, 465, or 483-485, or the RNA sequence of SEQ ID NO:580;

and/or the 3' replicase recognition sequence includes an RNA sequence encoded by at least one of SEQ ID Nos: 20-38, 406-454, 467, or 486-488, or the RNA sequence of SEQ ID NO:581. In other embodiments, the 5' replicase recognition sequence includes a sequence having at least 80% sequence identity to at least one of an RNA sequence encoded by SEQ ID Nos: 1-19, 372-405, 465, or 483-485, or to the RNA sequence of SEQ ID NO:580; and/or the 3' replicase recognition sequence includes a sequence having at least 80% sequence identity to an RNA sequence encoded by at least one of SEQ ID Nos: 20-38, 406-454, 467, or 486-488, or to the RNA sequence of SEQ ID NO:581. In embodiments, the 5' replicase recognition sequence and/or the 3' replicase recognition sequence comprises any of the aforementioned 5' replicase recognition sequences and/or 3' replicase recognition sequences present in recombinant RNA molecules disclosed herein.

In some embodiments, the 5' replicase recognition sequence is derived from an endornavirus; and/or the 3' replicase recognition sequence is derived from an endornavirus. Typically, the 5' replicase recognition sequence and the 3' replicase recognition sequence are derived from the same endornavirus.

In other embodiments, the 5' replicase recognition sequence and the 3' replicase recognition sequence are derived from different endornaviruses.

In embodiments, the viral coat protein is exogenously provided to the cell such as a plant cell. In embodiments, the plant cell further includes the viral coat protein. In other embodiments, the viral coat protein is recombinantly expressed in the plant cell.

In other embodiments, the cargo RNA sequence is up to about 14 kb in length.

In embodiments, the cargo RNA sequence includes: (a) at least one coding sequence, (b) at least one non-coding sequence, or (c) both at least one coding sequence and at least one non-coding sequence. In embodiments, the cargo RNA sequence includes at least one coding sequence, and wherein the RNA molecule further includes an IRES located 5' and immediately adjacent to the at least one coding sequence. In embodiments, the cargo RNA sequence includes multiple coding sequences, and wherein the RNA molecule further includes an IRES located 5' and immediately adjacent to each of the coding sequences.

In embodiments, the cargo RNA sequence includes at least one non-coding sequence, and wherein the at least one non-coding sequence is selected from the group consisting of a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; and a long noncoding RNA (lncRNA). In yet other embodiments, the recombinant DNA construct further includes a DNA sequence encoding the viral coat protein.

In embodiments, the recombinant DNA construct further includes a second promoter functional in the plant cell and operably linked to the DNA sequence encoding the viral plant protein.

In other embodiments, the cell such as a plant cell includes the endornavirus, wherein the endornavirus provides the plant cell the RDRP protein. In embodiments, the endornavirus is endemic to the plant cell. In embodiments, the endornavirus that is endemic to the plant cell is non-pathogenic and/or commensal to the plant cell. In other embodiments, the endornavirus is exogenously provided to the plant cell by introducing into the plant cell an exogenous endornavirus, e.g., an endornavirus that is natively found in a different organism, species, variety, or germplasm, and that is capable of self-replication when introduced into the plant cell.

In embodiments, the RDRP protein is exogenously provided to the cell such as a plant cell, e.g., by transgenic expression of the RDRP protein in the plant cell.

In embodiments, the recombinant RNA molecule is provided to the cell such as a plant cell by transcribing in the plant cell a recombinant DNA construct including a promoter functional in the plant cell and operably linked to a DNA sequence encoding the recombinant RNA molecule.

In embodiments, the method includes purifying the synthetic endornaviral satellite particle.

In embodiments, the method includes isolating the synthetic endornaviral satellite particle.

In embodiments, the method includes formulating the synthetic endornaviral satellite particle.

In another aspect, this disclosure accordingly is related to synthetic endornaviral satellite particle provided by the method described herein.

In another aspect, this disclosure is related to a method of providing a synthetic endornaviral satellite particle to a plant, including contacting (e.g., spraying, dusting, injecting, soaking, etc.) the plant with the synthetic endornaviral satellite particle.

vii. Producing a Modified Plant Propagule

In another aspect, this disclosure is related to a method of producing a modified plant propagule that comprises at least one plant cell comprising a recombinant RNA molecule. The method, in general, includes the steps of: isolating a plant propagule comprising at least one plant cell comprising a recombinant RNA molecule (e.g., a synthetic endornaviral satellite RNA) and an endornaviral RNA-dependent RNA polymerase (RDRP) from a mixed population of plant cells comprising both plant cells comprising the recombinant RNA molecule and plant cells lacking the recombinant RNA molecule, wherein the recombinant RNA molecule comprises, in 5' to 3' order, a 5' replicase recognition sequence that is capable of being recognized by the endornaviral RDRP; a cargo RNA sequence; and a 3' replicase recognition sequence that is capable of being recognized by the endornaviral RDRP. In embodiments, the recombinant RNA molecule is introduced into a population of plant cells (e.g., plant cells or protoplasts in culture, in callus, embryonic tissue, or other explant material, in root, axial, or apical meristem, in plant tissue or parts, or in an intact plant) by a recombinant DNA construct that includes DNA encoding the recombinant RNA molecule. In other embodiments the recombinant RNA molecule is introduced into the population of plant cells as RNA (e.g., as naked RNA or as RNA complexed or associated with a polypeptide, e.g., a viral coat protein, an antibody or antibody fragment, or a cationic polypeptide). Recombinant DNA that includes DNA encoding the recombinant RNA molecule can be introduced into plant cells by techniques including biolistic delivery (e.g., on gold and tungsten particles accelerated by a "gene gun"), delivery using a carrier (e.g., nanoparticles, nanofibers, nanotubes, lipid vesicles, micelles, or nanoparticles, surfactants, or clay particles or nanosheets), and bacterially mediated transformation (e.g., using an *Agrobacterium* sp., a *Sinorhizobium* sp., a *Mesorhizobium* sp., *Bradyrhizobium* sp., *Rhizobium* sp., or an *Ensifer* sp.). In an embodiment, *Agrobacterium tumefaciens* is used to transform plant cells with a recombinant DNA construct that includes left and right T-DNA sequences flanking DNA encoding the recombinant RNA molecule (a synthetic endornaviral satellite), e.g., as described in US patent application publications US20170369898 and US20180312854, each incorporated herein by reference in their entireties. In embodiments, after bacterially mediated transformation, plant cells that contain the recombinant RNA molecule (synthetic endornaviral satellite) are selected from the transformed population of plant cells; optionally, the selected plant cells do not contain the recombinant DNA construct or any other DNA resulting from the *Agrobacterium* transformation process, such as T-DNA sequences or other DNA from the *Agrobacterium* genome. In embodiments, the synthetic endornaviral satellite includes RNA encoding a selectable marker (e.g., a sequence that provides a visible phenotype or a sequence that provides resistance to a selection agent such as an antibiotic or an herbicide), and selection employs identification of those plant cells that have the selectable marker. In embodiments, the synthetic endornaviral satellite includes RNA encoding a protein that provides resistance to a selection agent, and the population of transformed plant cells is exposed to a sufficient amount of the selection agent to increase the percentage of surviving plant cells that contain the synthetic endornaviral satellite. In certain embodiments, the isolated plant propagule comprising at least one plant cell comprising a recombinant RNA molecule will be free or substantially free of plant cells lacking the recombinant RNA. Such isolated plant propagules which are substantially free of plant cells lacking the recombinant RNA can in certain embodiments comprise plant propagules where at least 75%, 80%, 85%, 90%, 95%, 98%, or 99% of the plant cells in the plant propagule contain the recombinant RNA molecule. In embodiments, the mixed population of plant cells comprise a population of protoplasts or a population of cells in callus, an explant, a plant part, or whole plant. In embodiments, the mixed population of plant cells can comprise a population of plant cells where less than 70%, 60%, 50%, 40%, 30%, 20%, 10%, 5%, or 1% of the plant cells in the population contain the recombinant RNA molecule. In some embodiments, the mixed population of plant cells comprise plant cells comprising the endornaviral RDRP and plant cells lacking the endornaviral RDRP. In certain embodiments, the plant cells lacking the endornaviral RDRP will also lack the recombinant RNA. In other embodiments, the mixed population of plant cells comprise plant cells comprising the endornaviral RDRP. In certain embodiments, the plant cells comprising the endornaviral RDRP can further comprise the recombinant RNA. In some embodiments, the cargo RNA sequence comprises RNA that encodes a selectable or scorable marker. In embodiments, the mixed population of plant cells is screened or selected for the presence of the plant cell comprising the recombinant RNA molecule prior to isolating the plant propagule. In such screens, the mixed population of cells or a portion thereof are subjected to an assay for a screenable marker for the presence of the recombinant RNA molecule (e.g., an RNA sequence diagnostic for presence of the recombinant RNA molecule or a polypeptide encoded by the recombinant RNA molecule) and separated from plant cells lacking the recombinant RNA molecule. In some embodiments, the isolation comprises selecting for the plant cell comprising the recombinant RNA molecule prior to isolating the plant propagule. Examples of such selections in instances where the recombinant RNA encodes a selectable marker (e.g., a protein which confers resistance to a selection agent such as an herbicide or antibiotic) can comprise exposing the mixed population of plant cells to a selection agent (e.g., an herbicide or antibiotic) and isolating plant cells which survive exposure to the selection agent. Examples of selectable marker/selection agent combinations include glyphosate-resistant EPSPS enzymes and/or glyphosate oxidases/glyphosate, a bialaphos resistance (bar) or phosphinothricin acyl transferase (pat) enzyme/glufosinate, or a neomycin phosphotransferase (npt)/neomycin or kanamycin. In certain embodiments, the selectable or scorable marker is an RNA aptamer (e.g., a Broccoli aptamer) or a regulatory RNA (e.g., an siRNA, siRNA precursor, miRNA, or miRNA precursor that downregulates expression of an endogenous gene in the plant, resulting in a detectable phenotype, e.g., bleaching caused by downregulation of a pigment-producing gene). In embodiments, the mixed population is located within a plant or a plant part. In some embodiments, the plant or plant part is screened or selected for presence of the recombinant RNA molecule prior to isolating the plant propagule. In other embodiments, the plant or plant part is screened or selected for systemic presence of the recombinant RNA molecule prior to isolating the plant propagule. In some embodiments, the plant cells, plant, or plant part in the mixed population or that are isolated lack DNA that encodes the recombinant RNA molecule. In embodiments, the plant propagule comprising the recombinant RNA molecule is isolated by detecting the RNA molecule in one or more plant cells comprising the recombinant RNA molecule and separating the one or more plant cells comprising the recombinant RNA molecule from the plant cells lacking the recombinant DNA molecule. In some embodiments, the plant propagule is a mosaic comprising both plant cells comprising the recombinant RNA molecule and plant cells lacking the recombinant RNA molecule. In other embodiments, the modified plant propagule is a mosaic comprising both plant cells comprising the endornaviral RDRP and plant cells lacking the endornaviral RDRP. In certain embodiments, at least 99%, 98%, 95%, 90%, 85%, 80%, 70%, 60%, 50%, 40%, 30%, 20%, 10%, 5%, or 1% of the plant cells in the mosaic can comprise the recombinant RNA molecule. In certain embodiments that are particularly advantageous for at least regulatory reasons, the plant propagule lacks DNA that encodes the recombinant RNA molecule. In embodiments, the modified plant propagule comprises the cell comprising the recombinant RNA molecule, or a seed, seedling, ovule, embryo, pollen, root, stem, leaf, shoot, tuber, rhizome, stolon, bulb, explant, or callus comprising the cell comprising the recombinant RNA molecule. Plant propagules made by any of the aforementioned methods and/or incorporating any of the aforementioned features are also provided herein.

In some embodiments, any of the aforementioned methods can further comprise multiplying the cell, seed, seedling, ovule, embryo, pollen, root, stem, leaf, shoot, tuber, rhizome, stolon, bulb, explant, or callus to obtain progeny, wherein the progeny comprise the recombinant RNA molecule. In other embodiments, the multiplying of the cells consists of culturing a plurality of explants obtained from the cell, seed, seedling, ovule, embryo, pollen, root, stem, leaf, shoot, tuber, rhizome, stolon, bulb, explant, or callus. In yet other embodiments, the isolated propagule comprises the cell and the aforementioned methods can further comprise regenerating a plant, seedling, ovule, embryo, pollen, root, stem, leaf, shoot, tuber, rhizome, stolon, bulb, explant, or callus comprising the recombinant RNA from the cell. In still other embodiments, the isolated propagule comprises callus and the aforementioned methods can further comprise regenerating a plant, seedling, ovule, embryo, pollen, root, stem, leaf, shoot, tuber, rhizome, stolon, bulb, or explant comprising the recombinant RNA from said callus. In embodiments, a plant is regenerated, and the aforementioned methods can further comprise recovering $F_1$ seed or $F_1$ progeny or clonal progeny comprising the recombinant RNA from the plant.

viii. Providing a Synthetic Endornaviral Satellite RNA to a Plant Through Grafting In another aspect, this disclosure is related to a method of providing a synthetic endornaviral satellite RNA to a plant or plant part by grafting one plant part to another plant part. In certain embodiments, the methods can comprise grafting a scion onto a rootstock comprising any of the aforementioned or otherwise disclosed recombinant DNA molecules and/or recombinant RNA molecules (e.g., a recombinant RNA comprising, in 5' to 3' order, a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP), wherein at least one cell of the rootstock and/or the scion comprises the endornaviral RDRP. In certain embodiments, the scion can comprise a plant shoot, an apical or other meristem, a leaf attached to a petiole, or other plant part and the rootstock can comprise roots and aerial portions of the plant including the main stem, secondary stems, leaves, and/or reproductive structures of the plant, In embodiments, DNA that encodes the recombinant RNA molecule is absent in the scion and/or the rootstock. In embodiments, the scion lacks the recombinant RNA molecule prior to grafting. In embodiments, the rootstock comprises the endornaviral RDRP. In some embodiments, the endornaviral RDRP is provided by an endornavirus endemic to the rootstock (e.g., an endornavirus which is non-pathogenic and/or commensal). In other embodiments, the endornaviral RDRP is exogenously provided to the rootstock (e.g., via a DNA expression cassette which is integrated into the chromosomal or plastidic DNA of the rootstock or via a recombinant viral vector comprising DNA or RNA encoding the RDRP). In embodiments, the scion comprises the endornaviral RDRP. In some embodiments, the RDRP is provided by an endornavirus endemic to the scion (e.g., an endornavirus which is non-pathogenic and/or commensal). In other embodiments, the RDRP is exogenously provided to the scion (e.g., via a DNA expression cassette which is integrated into the chromosomal or plastidic DNA of the scion or via a recombinant viral vector comprising DNA or RNA encoding the RDRP). In embodiments, the rootstock and/or the scion comprises a heterologous viral coat protein which can encapsidate the recombinant RNA molecule. In some embodiments, the rootstock and/or the scion comprises the recombinant RNA molecule encapsidated by a heterologous viral coat protein.

ix. Producing a Grafted Plant

In another aspect, this disclosure is related to a method of producing a grafted plant comprising a recombinant RNA molecule comprising, in 5' to 3' order, a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP. This disclosure is also directed to grafted plants, wherein the rootstock and or scion of the grafted plant comprise at least one cell comprising the recombinant RNA and the endornaviral RDRP. In certain embodiments, the grafted plants are grafted plants made by the methods disclosed herein. In certain embodiments, the recombinant RNA molecule is provided by contacting the scion, the rootstock, or both the scion and the rootstock with a composition comprising the recombinant RNA molecule prior to grafting the scion onto the rootstock to produce the grafted plant. In certain embodiments, at least one cell of the rootstock and/or the scion comprises an endornaviral RDRP prior to contacting the scion, the rootstock, or both the scion and the rootstock with the composition. In embodiments, the rootstock comprises the endornaviral RDRP. In some embodiments, the endornaviral RDRP is provided by an endornavirus endemic to the rootstock (e.g., an endornavirus which is non-pathogenic and/or commensal). In other embodiments, the endornaviral RDRP is exogenously provided to the rootstock (e.g., via a DNA expression cassette which is integrated into the chromosomal or plastidic DNA of the rootstock or via a recombinant viral vector comprising DNA or RNA encoding the RDRP). In embodiments, the scion comprises the endornaviral RDRP. In some embodiments, the RDRP is provided by an endornavirus endemic to the scion (e.g., an endornavirus which is non-pathogenic and/or commensal). In other embodiments, the RDRP is exogenously provided to the scion (e.g., via a DNA expression cassette which is integrated into the chromosomal or plastidic DNA of the scion or via a recombinant viral vector comprising DNA or RNA encoding the RDRP). In embodiments, DNA that encodes the recombinant RNA molecule is absent in the scion, the rootstock, and/or the grafted plant. The composition can be provided to the scion, the rootstock, or both the scion and the rootstock according to any of the formulations disclosed herein. In some embodiments, the formulation is a liquid, a gel, or a powder. In some embodiments, the formulation is configured to be sprayed on to the scion, the rootstock, or both the scion and the rootstock; to be injected into the scion, the rootstock, or both the scion and the rootstock; to be soaked into the scion, the rootstock, or both the scion and the rootstock; or to be coated onto the scion, the rootstock, or both the scion and the rootstock. In certain embodiments, the contacting comprises dipping the scion, the rootstock, or both the scion and the rootstock into the composition prior to grafting.

x. Producing a Plant that Transmits a Recombinant RNA Molecule to Progeny Plants or Seed In another aspect, this disclosure is related to a method for producing a plant that transmits any of the aforementioned or otherwise disclosed recombinant RNA molecules provided herein to progeny plants or seed. In certain embodiments, the methods include the steps of: isolating an $F_1$ progeny plant or seed comprising at least one cell comprising an endornaviral RNA-dependent RNA polymerase (RDRP) and the recombinant RNA molecule comprising, in 5' to 3' order, a 5' replicase recognition sequence that is capable of being recognized by the endornaviral RDRP); a cargo RNA sequence; and a 3' replicase recognition sequence that is capable of being recognized by the endornaviral RDRP from a population of $F_1$ plants or seed obtained from at least one parent plant comprising the recombinant RNA molecule. In embodiments, the parent plant or a part thereof comprising the plant cell is screened or selected for presence of the recombinant RNA molecule prior to isolating the $F_1$ progeny plant or seed. In some embodiments, the parent plant or one or more parts thereof are screened for systemic presence of the recombinant RNA molecule prior to isolating the $F_1$ progeny plants. In other embodiments, floral tissue (e.g., whole flowers or buds, sepal, calyx, or petal), male reproductive tissue (e.g., stamen, anther, or pollen), or female reproductive tissue (e.g., whole fruit, ovary, pericarp, ovule, seed coat, endosperm, or embryo) of the parent plant is screened or selected for presence of the recombinant RNA molecule. In embodiments, $F_1$ seeds are obtained from a parent plant selected for presence of the recombinant RNA molecule in pericarp tissue. In embodiments, the $F_1$ progeny plant or seed comprising the cell is isolated by screening the population of $F_1$ plants or seed obtained from a parent plant for the presence of the recombinant RNA molecule and propagating the $F_1$ progeny plant or seed comprising the recombinant RNA molecule. In such screens, the progeny plants or seed thereof are subjected to an assay for a screenable marker for the presence of the recombinant RNA (e.g., an RNA sequence diagnostic for presence of the recombinant RNA molecule or a polypeptide encoded by the recombinant RNA molecule) and separated from progeny plants and seed lacking the recombinant RNA progeny plants and seed lacking the recombinant RNA. Such screening assays can be non-destructive assays wherein a portion of the progeny seed or plant is removed and assayed without loss of the viability or ability to propagate the seed or plant tissue comprising the recombinant RNA. In some embodiments, an $F_1$ seed of the parent plant is non-destructively screened for presence of the recombinant RNA molecule. In other embodiments, the $F_1$ seed of the parent plant is non-destructively screened by assaying maternally derived or endosperm tissue of the seed for the presence of the recombinant RNA molecule. Methods for non-destructive assays of seed or other plant tissue which can be adapted for such screens include but are not limited to those disclosed in US patent applications US20220221377 and US20210259176, both incorporated herein by reference in their entireties. In some embodiments, the cargo RNA sequence comprises RNA that encodes a selectable or scorable marker. In some embodiments, the recombinant RNA molecule encodes a selectable marker and the $F_1$ progeny plant or seed comprising the recombinant RNA molecule is isolated by selecting the $F_1$ progeny plant or seed comprising the recombinant RNA molecule for presence of the selectable marker. Examples of such selections in instances where the recombinant RNA encodes a selectable marker (e.g., a protein which confers resistance to a selection agent such as an herbicide or antibiotic) can comprise exposing the progeny seeds or plants to a selection agent (e.g., an herbicide or antibiotic) and isolating progeny seeds or plants which survive exposure to the selection agent. Examples of selectable marker/selection agent combinations include glyphosate-resistant EPSPS enzymes and/or glyphosate oxidases/glyphosate, a bialaphos resistance (bar) or phosphinothricin acyl transferase (pat) enzymes/glufosinate, and neomycin phosphotransferase (npt)/neomycin or kanamycin. In certain embodiments, the selectable or scorable marker is an RNA aptamer or a regulatory RNA. In some embodiments, the parent plant lacks DNA that encodes the recombinant RNA molecule. In certain embodiments that are particularly advantageous for at least regulatory reasons, the $F_1$ progeny plant or seed lack DNA that encodes the recombinant RNA molecule. In embodiments, the selected $F_1$ progeny plant transmits the recombinant RNA molecule to at least F2 progeny. In some embodiments, the $F_1$ progeny plant or seed population is obtained from a parent plant used as a pollen recipient. In other embodiments, the $F_1$ progeny plant or seed population is obtained from a parent plant used as a pollen donor. In embodiments, the $F_1$ progeny plant or seed population is obtained by selfing (self-pollinating) the parent plant. In other embodiments, the $F_1$ progeny plant or seed population is obtained from the sexual crossing (cross-pollination) of two parent plants. In some embodiments, the parent plant that comprises the recombinant RNA molecule is the female parent plant. In other embodiments, the parent plant that comprises the recombinant RNA molecule is the male parent plant, and the recombinant RNA molecule is transmitted in pollen of the male parent plant.

In certain embodiments, the methods can further comprise introducing the recombinant RNA molecule or a polynucleotide encoding the recombinant RNA molecule into a plant cell and obtaining the parent plant comprising the recombinant RNA molecule from the plant cell. In embodiments, the recombinant RNA molecule further comprises at least one additional element selected from the group consisting of: (a) at least one RNA encoding a viral movement protein (MP); (b) at least one tRNA-like sequence; and c) an origin-of-assembly sequence (OAS). In embodiments, a parent and/or plant comprises a heterologous viral coat protein which can encapsidate the recombinant RNA molecule. In some embodiments, the parent and/or progeny plant comprises the recombinant RNA molecule encapsidated by a heterologous viral coat protein.

xi. Barcoding a Plant, Plant Cell, Progeny Thereof or Part Thereof

In another aspect, this disclosure is related to a method of barcoding a plant, plant cell, progeny thereof, or part thereof. The methods comprise providing to the plant or plant cell any of the aforementioned or otherwise disclosed recombinant RNA molecules provided herein, wherein the cargo RNA of the recombinant RNA molecule comprises a barcode RNA molecule, and wherein the plant or plant cell comprises an endornaviral RDRP. In embodiments, the barcode RNA molecule comprises a sequence that uniquely identifies the plant, plant cell, progeny thereof, or part thereof. In some embodiments, the barcode RNA can be a randomly generated sequence. In some embodiments, the barcode RNA molecule comprises a sequence that is not present in the genome and/or transcriptome of a wild-type plant of the same species, a pathogen thereof, or a symbiont thereof. In some embodiments, the barcode RNA molecule comprises a forward primer binding site and a reverse primer binding site for detection of the barcode RNA molecule. In embodiments, the barcode RNA molecule includes a forward primer binding site comprising a sequence that is not present in the genome of the plant or plant cell or of an organelle in the plant or plant cell, and is not present in a cell of a pest, pathogen, or symbiont of the plant or plant cell, and/or a reverse primer binding site comprising a sequence that is not present in the genome of the plant or plant cell or of an organelle in the plant or plant cell, and is not present in a cell of a pest, pathogen, or symbiont of the plant or plant cell. In embodiments, the barcode RNA molecule comprises a non-protein coding sequence. In some embodiments, the barcode RNA sequence is up to about 14 kb in length. In some embodiments, the barcode RNA has a length of 10 to 5000 nucleotides, 20 to 1000 nucleotides, or 50 to 500 nucleotides. In certain embodiments, the barcode RNA molecule has a length of 10, 20, 30, 40, 50, 60, 70, 80, 90, 100, 110, 120, 130, 140, 150, 160, 170, 180, 190, 200, 250, 300, 350, 400, 450, 500, 550, 600, 650, 700, 750, 800, 850, 900, 950, 1000, 1500, 2000, 2500, 3000, 3500, 4000, 4500, or 5000 nucleotides. In embodiments, the plant transmits the recombinant RNA molecule comprising the barcode RNA to progeny. In embodiments, the plant, plant cell, progeny thereof, or part thereof lacks DNA that encodes the recombinant RNA molecule. In some embodiments, the methods can further comprise isolating an $F_1$ progeny plant or seed comprising at least one cell comprising the endornaviral RDRP and the recombinant RNA molecule. In some embodiments, the $F_1$ progeny plant or seed is obtained from the plant used as a pollen recipient. In other embodiments, the $F_1$ progeny plant or seed is obtained from the plant used as a pollen donor. In embodiments, the $F_1$ progeny plant or seed is obtained by selfing the parent plant. In embodiments, the methods can further comprise propagating the plant or plant cell to obtain a plant part or a plant propagule comprising the barcode RNA molecule.

xii. Identifying a Barcoded Plant, Plant Part, or Plant Cell

In another aspect, this disclosure is related to a method of identifying a barcoded plant, plant part, or plant cell. The methods comprise screening for the presence of a barcode RNA molecule in the plant, plant part, or plant cell, wherein the plant, plant part, or plant cell comprises any of the aforementioned or otherwise disclosed recombinant RNA molecules provided herein, and wherein the cargo RNA of the recombinant RNA molecule comprises the barcode RNA molecule. In certain embodiments, the methods comprise obtaining a nucleic acid sample from the plant, plant part, or plant cell; and detecting the presence of the barcode RNA molecule in the sample. Assays for detection of a barcode RNA include RNA detection assays (e.g., an RT-PCR assay) using nucleic acid probes and/or primers which can detect the barcode RNA and/or sequencing of the barcode RNA. Such screening assays can be non-destructive assays wherein a portion of the seed or plant is removed and assayed without loss of the viability or ability to propagate the seed or plant tissue comprising the barcode RNA.

Methods for non-destructive assays of seed or other plant tissue which can be adapted for such screens include but are not limited to those disclosed in US patent applications US20220221377 and US20210259176, both incorporated herein by reference in their entireties. In some embodiments, a seed of the plant is non-destructively screened for presence of the barcode RNA molecule. In other embodiments, a seedling, ovule, embryo, pollen, root, stem, leaf, shoot, tuber, rhizome, stolon, bulb, explant, or callus is screened for the presence of the barcode RNA molecule.

Formulations of Recombinant Polynucleotides

The polynucleotides and other molecules described herein can be formulated either in pure form (e.g., the composition contains only the recombinant polynucleotide) or together with one or more additional formulation components to facilitate application or delivery of the compositions. In embodiments, the additional formulation component includes, e.g., a carrier (i.e., a component that has an active role in delivering the active agent (e.g., recombinant polynucleotide); for example, a carrier can encapsulate, covalently or non-covalently modify, or otherwise associate with the active agent in a manner that improves delivery of the active agent) or an excipient (e.g., a delivery vehicle, adjuvant, diluent, surfactant, stabilizer, or tonicity agent). In some embodiments, the composition is formulated for delivery to a plant.

In some aspects, the disclosure provides a formulation comprising any of the compositions described herein. In some embodiments, the formulation is a liquid, a gel, or a powder. In some embodiments, the formulation is configured to be sprayed on plants, to be injected into plants, to be rubbed on leaves, to be soaked into plants or seeds, to be coated onto plants, or be coated on seeds, or to be delivered through root uptake (e.g., in a hydroponic system or via soil).

Depending on the intended objectives and prevailing circumstances, the composition can be formulated into emulsifiable concentrates, suspension concentrates, directly sprayable or dilutable solutions, coatable pastes, diluted emulsions, spray powders, soluble powders, dispersible powders, wettable powders, dusts, granules, encapsulations in polymeric substances, microcapsules, foams, aerosols, carbon dioxide gas preparations, tablets, resin preparations, paper preparations, nonwoven fabric preparations, or knitted or woven fabric preparations. In some instances, the composition is a liquid. In some instances, the composition is a solid. In some instances, the composition is an aerosol, such as in a pressurized aerosol can.

In some instances, the recombinant polynucleotide makes up about 0.1% to about 100% of the composition, such as any one of about 0.01% to about 100%, about 1% to about 99.9%, about 0.1% to about 10%, about 1% to about 25%, about 10% to about 50%, about 50% to about 99%, or about 0.1% to about 90% of active ingredients (e.g., recombinant polynucleotides). In some instances, the composition includes at least any of 0.1%, 0.5%, 1%, 5%, 10%, 20%, 30%, 40%, 50%, 60%, 70%, 80%, 90%, 95%, or more active ingredients (e.g., recombinant polynucleotides). In some instances, the concentrated agents are preferred as commercial products, the final user normally uses diluted agents, which have a substantially lower concentration of active ingredient.

i. Formulation for Topical Delivery

In some embodiments, the composition is formulated for topical delivery to a plant. In some embodiments, the topical delivery is spraying, leaf rubbing, soaking, coating (e.g., coating using micro-particulates or nano-particulates), or delivery through root uptake (e.g., delivery in a hydroponic system or through the soil or other growth medium). In embodiments, the composition is formulated for delivery to a seed, e.g., by coating or soaking.

In some embodiments, the composition further comprises a carrier and/or an excipient. In other embodiments, the composition does not comprise a carrier or excipient, e.g., comprises a naked polynucleotide (e.g., a naked RNA).

In some embodiments, the recombinant polynucleotide is delivered at a concentration of at least 0.1 grams per acre, e.g., at least 0.1, 1, 2, 5, 10, 15, 20, 25, 30, 35, 40, 45, or 50 grams per acre. In some embodiments, less than 120 liters per acre is delivered, e.g., less than 110, 100, 90, 80, 70, 60, 50, 40, 30, 20, 15, 10, 5, or 2 liters per acre or less than 1 liter per acre.

ii. Carriers

In some aspects, the formulation comprises a carrier. In some embodiments the formulation is an emulsion or a reverse emulsion, a liquid, or a gel. In embodiments, the formulation includes a carrier that serves as a physical support (e.g., solid or semi-solid surfaces or matrices, powders, or particles or nanoparticles). In embodiments, the active agent is encapsulated or enclosed in or attached to or complexed with a carrier including a liposome, vesicle, micelle, or other fluid compartment. In embodiments, the active agent is encapsulated or enclosed in or attached to or complexed with a carrier including a naturally occurring or synthetic, branched or linear polymer (e.g., pectin, agarose, chitin, chitosan, DEAE-dextran, polyvinylpyrrolidone ("PVP"), or polyethylenimine ("PEI")). In embodiments the carrier includes cations or a cationic charge, such as cationic liposomes or cationic polymers such as polyamines (e.g., spermine, spermidine, putrescine). In embodiments, the carrier includes a polypeptide such as an enzyme, (e.g., cellulase, pectolyase, maceroenzyme, pectinase), a cell penetrating or pore-forming peptide (e.g., poly-lysine, poly-arginine, or poly-homoarginine peptides). In embodiments, the recombinant polynucleotide (e.g., a synthetic endornaviral satellite RNA) is formulated with or delivered with one or more reagents to promote thiol-mediated uptake into a cell (such as a plant cell); embodiments of such reagents include cell-penetrating polydisulfides, (CPDs), cyclic oligochalcogenides (COCs), and a "helper" oligonucleotide that has a sequence that allows at least partial hybridization to the recombinant polynucleotide and that is modified with polydisulfide units (e.g., from 5-20 disulfide units); see, e.g., Laurent et al. (2021), JACSAu, 1:710-728, DOI:10.1021/jacsau.lc00128; Mou et al. (2022) Science Advances, 8, eabo0902, DOI:10.1126/sciadv.abo0902.

Non-limiting examples of carriers include cationic liposomes and polymer nanoparticles reviewed by Zhang et al. (2007) J. Controlled Release, 123:1-10, and the cross-linked multilamellar liposomes described in US Patent Application Publication 2014/0356414 A1, incorporated by reference in its entirety herein. In embodiments, the carrier includes a nanomaterial, such as carbon or silica nanoparticles, carbon nanotubes, carbon nanofibers, or carbon quantum dots. Non-limiting examples of carriers include particles or nanoparticles (e.g., particles or nanoparticles made of materials such as carbon, silicon, silicon carbide, gold, tungsten, polymers, or ceramics) in various size ranges and shapes, magnetic particles or nanoparticles (e.g., silenceMag Magnetotransfection™ agent, OZ Biosciences, San Diego, CA), abrasive or scarifying agents, needles or microneedles, matrices, and grids.

In certain embodiments, particulates and nanoparticulates are useful in delivery of the polynucleotide composition or the nuclease or both. Useful particulates and nanoparticles include those made of metals (e.g., gold, silver, tungsten, iron, cerium), ceramics (e.g., aluminum oxide, silicon carbide, silicon nitride, tungsten carbide), polymers (e.g., polystyrene, polydiacetylene, and poly(3,4-ethylenedioxythiophene) hydrate), semiconductors (e.g., quantum dots), silicon (e.g., silicon carbide), carbon (e.g., graphite, graphene, graphene oxide, or carbon nanosheets, nanocomplexes, or nanotubes), and composites (e.g., polyvinylcarbazole/graphene, polystyrene/graphene, platinum/graphene, palladium/graphene nanocomposites). In certain embodiments, such particulates and nanoparticulates are further covalently or non-covalently functionalized, or further include modifiers or cross-linked materials such as polymers (e.g., linear or branched polyethylenimine, poly-lysine), polynucleotides (e.g., DNA or RNA), polysaccharides, lipids, polyglycols (e.g., polyethylene glycol, thiolated polyethylene glycol), polypeptides or proteins, and detectable labels (e.g., a fluorophore, an antigen, an antibody, or a quantum dot). In various embodiments, such particulates and nanoparticles are neutral, or carry a positive charge, or carry a negative charge.

Embodiments of compositions including particulates include those formulated, e.g., as liquids, colloids, dispersions, suspensions, aerosols, gels, and solids. Embodiments include nanoparticles affixed to a surface or support, e.g., an array of carbon nanotubes vertically aligned on a silicon or copper wafer substrate. Embodiments include polynucleotide compositions including particulates (e.g., gold or tungsten or magnetic particles) delivered by a Biolistic-type technique or with magnetic force. The size of the particles used in Biolistics is generally in the "microparticle" range, for example, gold microcarriers in the 0.6, 1.0, and 1.6 micrometer size ranges (see, e.g., instruction manual for the Helios® Gene Gun System, Bio-Rad, Hercules, CA; Randolph-Anderson et al. (2015) "Submicron gold particles are superior to larger particles for efficient Biolistic® transformation of organelles and some cell types", Bio-Rad US/EG Bulletin 2015), but successful Biolistics delivery using larger (40-48-WO 2019/144124 PCT/0S2019/014559 nanometer) nanoparticles has been reported in cultured animal cells; see O'Brian and Lummis (2011) BMC Biotechnol., 11:66-71.

Other embodiments of useful particulates are nanoparticles, which are generally in the nanometer (nm) size range or less than 1 micrometer, e.g., with a diameter of less than about 1 nm, less than about 3 nm, less than about 5 n, less than about 10 n, less than about 20 n, less than about 40 nm, less than about 60 nm, less than about 80 nm, and less than about 100 nm. Specific, non-limiting embodiments of nanoparticles commercially available (all from Sigma-Aldrich Corp., St. Louis, MO) include gold nanoparticles with diameters of 5, 10, or 15 nm; silver nanoparticles with particle sizes of 10, 20, 40, 60, or 100 nm; palladium "nanopowder" of less than 25 nm particle size; single-, double-, and multi-walled carbon nanotubes, e.g., with diameters of 0.7-1.1, 1.3-2.3, 0.7-0.9, or O. 7-1.3 nm, or with nano tube bundle dimensions of 2-10 nm by 1-5 micrometers, 6-9 nm by 5 micrometers, 7-15 nm by 0.5-10 micrometers, 7-12 nm by 0.5-10 micrometers, 110-170 nm by 5-9 micrometers, 6-13 nm by 2.5-20 micrometers. Embodiments include polynucleotide compositions including materials such as gold, silicon, cerium, or carbon, e.g., gold or gold-coated nanoparticles, silicon carbide whiskers, carborundum, porous silica nanoparticles, gelatin/silica nanoparticles, nanoceria or cerium oxide nanoparticles (CNPs), carbon nanotubes (CNTs) such as single-, double-, or multi-walled carbon nanotubes and their chemically functionalized versions (e.g., carbon nanotubes functionalized with amide, amino, carboxylic acid, sulfonic acid, or polyethylene glycol moieties), and graphene or graphene oxide or graphene complexes; see, for example, Wong et al. (2016) Nano Lett., 16: 1161-1172; Giraldo et al. (2014) Nature Materials, 13:400-409; Shen et al. (2012) Theranostics, 2:283-294; Kim et al. (2011) Bioconjugate Chem., 22:2558-2567; Wang et al. (2010) J. Am. Chem. Soc. Comm., 132:9274-9276; Zhao et al. (2016) Nanoscale Res. Lett., 11: 195-203; and Choi et al. (2016) J. Controlled Release, 235:222-235. See also, for example, the various types of particles and nanoparticles, their preparation, and methods for their use, e.g., in delivering polynucleotides and polypeptides to cells, disclosed in US Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

iii. Excipients

In some aspects, the composition includes an excipient, e.g., a delivery vehicle, adjuvant, diluent, surfactant, stabilizer, or tonicity agent or a combination thereof. In some embodiments, the excipient is a crop oil concentrate, a vegetable oil concentrate, a modified vegetable oil, a nitrogen source, a deposition (drift control) and/or retention agent (with or without ammonium sulfate and/or defoamer), a compatibility agent, a buffering agent and/or acidifier, a water conditioning agent, a basic blend, a spreader-sticker and/or extender, an adjuvant plus foliar fertilizer, an antifoam agent, a foam marker, a scent, or a tank cleaner and/or neutralizer. In some embodiments, the excipient is an adjuvant described in the Compendium of Herbicide Adjuvants (Young et al. (2016). Compendium ofHerbicide Adjuvants ($13^{th}$ ed.), Purdue University).

Examples of delivery vehicles and diluents include, but are not limited to, lactose, dextrose, sucrose, sorbitol, mannitol, starches, gum acacia, calcium phosphate, alginates, tragacanth, gelatin, calcium silicate, microcrystalline cellulose, polyvinylpyrrolidone, cellulose, water, saline solution, syrup, methylcellulose, methyl- and propylhydroxybenzoates, talc, magnesium stearate, and mineral oil. Further exemplary delivery vehicles include, but are not limited to, solid or liquid excipient materials, solvents, stabilizers, slow-release excipients, colorings, and surface-active substances (surfactants). In some instances, the excipient (e.g., delivery vehicle) is a stabilizing vehicle. In embodiments, the stabilizing vehicle includes, e.g., an epoxidized vegetable oil, an antifoaming agent, e.g., silicone oil, a preservative, a viscosity regulator, a binding agent, or a tackifier. In some instances, the stabilizing vehicle is a buffer suitable for the recombinant polynucleotide. In some instances, the composition is microencapsulated in a polymer bead delivery vehicle. In some instances, the stabilizing vehicle protects the recombinant polynucleotide against UV and/or acidic conditions. In some instances, the delivery vehicle contains a pH buffer. In some instances, the composition is formulated to have a pH in the range of about 4.5 to about 9.0, including for example pH ranges of about any one of 5.0 to about 8.0, about 6.5 to about 7.5, or about 6.5 to about 7.0.

iv. Adjuvants

In some instances, the composition provided herein includes an adjuvant. Adjuvants are agents that do not possess the polynucleotide activity but impart beneficial properties to a formulation. For example, adjuvants are either pre-mixed in the formulation or added to a spray tank to improve mixing or application or to enhance performance. They are used extensively in products designed for foliar applications. Adjuvants can be used to customize the formulation to specific needs and compensate for local conditions. Adjuvants can be designed to perform specific functions, including wetting, spreading, sticking, reducing evaporation, reducing volatilization, buffering, emulsifying, dispersing, reducing spray drift, and reducing foaming. No single adjuvant can perform all these functions, but compatible adjuvants often can be combined to perform multiple functions simultaneously.

Among nonlimiting examples of adjuvants included in the formulation are binders, dispersants and stabilizers, specifically, for example, casein, gelatin, polysaccharides (e.g., starch, gum arabic, cellulose derivatives, alginic acid, etc.), lignin derivatives, bentonite, sugars, synthetic water-soluble polymers (e.g., polyvinyl alcohol, polyvinylpyrrolidone, polyacrylic acid, etc.), PAP (acidic isopropyl phosphate), BHT (2,6-di-t-butyl-4-methylphenol), BHA (a mixture of 2-t-butyl-4-methoxyphenol and 3-t-butyl-4-methoxyphenol), vegetable oils, mineral oils, fatty acids and fatty acid esters.

v. Liquid and Gaseous Formulations

In embodiments, the compositions provided herein are in a liquid formulation. Liquid formulations are generally mixed with water, but in some instances are used with crop oil, diesel fuel, kerosene or other light oil as an excipient. The amount of active ingredient (e.g., recombinant polynucleotides) often ranges from about 0.5 to about 80 percent by weight.

In embodiments, an emulsifiable concentrate formulation contains a liquid active ingredient, one or more petroleum-based solvents, and an agent that allows the formulation to be mixed with water to form an emulsion. Such concentrates can be used in agricultural, ornamental and turf, forestry, structural, food processing, livestock, and public health pest formulations. In embodiments, these are adaptable to application equipment from small portable sprayers to hydraulic sprayers, low-volume ground sprayers, mist blowers, and low-volume aircraft sprayers. Some active ingredients readily dissolve in a liquid excipient. When mixed with an excipient, they form a solution that does not settle out or separate, e.g., a homogenous solution. In embodiments, formulations of these types include an active ingredient, a carrier and/or an excipient, and one or more other ingredients. Solutions can be used in any type of sprayer, indoors and outdoors.

In some instances, the composition is formulated as an invert emulsion. An invert emulsion is a water-soluble active ingredient dispersed in an oil excipient. Invert emulsions require an emulsifier that allows the active ingredient to be mixed with a large volume of petroleum-based excipient, usually fuel oil. Invert emulsions aid in reducing drift. With other formulations, some spray drift results when water droplets begin to evaporate before reaching target surfaces; as a result, the droplets become very small and lightweight. Because oil evaporates more slowly than water, invert emulsion droplets shrink less, and more active ingredient reaches the target. Oil further helps to reduce runoff and improve rain resistance. It further serves as a sticker-spreader by improving surface coverage and absorption. Because droplets are relatively large and heavy, it is difficult to get thorough coverage on the undersides of foliage. Invert emulsions are most commonly used along rights-of-way where drift to susceptible non-target areas can be a problem.

A flowable or liquid formulation combines many of the characteristics of emulsifiable concentrates and wettable powders. Manufacturers use these formulations when the active ingredient is a solid that does not dissolve in either water or oil. The active ingredient, impregnated on a substance such as clay, is ground to a very fine powder. The powder is then suspended in a small amount of liquid. The resulting liquid product is quite thick. Flowables and liquids share many of the features of emulsifiable concentrates, and they have similar disadvantages. They require moderate agitation to keep them in suspension and leave visible residues, similar to those of wettable powders.

Flowables/liquids are easy to handle and apply. Because they are liquids, they are subject to spilling and splashing. They contain solid particles, so they contribute to abrasive wear of nozzles and pumps. Flowable and liquid suspensions settle out in their containers. Because flowable and liquid formulations tend to settle, packaging in containers of five gallons or less makes remixing easier.

Aerosol formulations contain one or more active ingredients and a solvent. Most aerosols contain a low percentage of active ingredients. There are two types of aerosol formulations—the ready-to-use type commonly available in pressurized sealed containers and those products used in electrical or gasoline-powered aerosol generators that release the formulation as a smoke or fog.

Ready to use aerosol formulations are usually small, self-contained units that release the formulation when the nozzle valve is triggered. The formulation is driven through a fine opening by an inert gas under pressure, creating fine droplets. These products are used in greenhouses, in small areas inside buildings, or in localized outdoor areas. Commercial models, which hold five to 5 pounds of active ingredient, are usually refillable.

Smoke or fog aerosol formulations are not under pressure. They are used in machines that break the liquid formulation into a fine mist or fog (aerosol) using a rapidly whirling disk or heated surface.

In some embodiments, the composition comprises a liquid excipient. In embodiments, a liquid excipient includes, for example, aromatic or aliphatic hydrocarbons (e.g., xylene, toluene, alkylnaphthalene, phenylxylylethane, kerosene, gas oil, hexane, cyclohexane, etc.), halogenated hydrocarbons (e.g., chlorobenzene, dichloromethane, dichloroethane, trichloroethane, etc.), alcohols (e.g., methanol, ethanol, isopropyl alcohol, butanol, hexanol, benzyl alcohol, ethylene glycol, etc.), ethers (e.g., diethyl ether, ethylene glycol dimethyl ether, diethylene glycol monomethyl ether, diethylene glycol monoethyl ether, propylene glycol monomethyl ether, tetrahydrofuran, dioxane, etc.), esters (e.g., ethyl acetate, butyl acetate, etc.), ketones (e.g., acetone, methyl ethyl ketone, methyl isobutyl ketone, cyclohexanone, etc.), nitriles (e.g., acetonitrile, isobutyronitrile, etc.), sulfoxides (e.g., dimethyl sulfoxide, etc.), amides (e.g., N,N-dimethylformamide, N,N-dimethylacetamide, cyclic imides (e.g. N-methylpyrrolidone) alkylidene carbonates (e.g., propylene carbonate, etc.), vegetable oil (e.g., soybean oil, cottonseed oil, etc.), vegetable essential oils (e.g., orange oil, hyssop oil, lemon oil, etc.), or water.

In some embodiments, the composition comprises a gaseous excipient. Gaseous excipients include, for example, butane gas, flon gas, liquefied petroleum gas (LPG), dimethyl ether, and carbon dioxide gas.

vi. Dry or Solid Formulations

Dry formulations can be divided into two types: ready-to-use and concentrates that must be mixed with water to be applied as a spray. Most dust formulations are ready to use and contain a low percentage of active ingredients (less than about 10 percent by weight), plus a very fine, dry inert excipient made from talc, chalk, clay, nut hulls, or volcanic ash. The size of individual dust particles varies. A few dust formulations are concentrates and contain a high percentage of active ingredients. Mix these with dry inert excipients before applying. Dusts are always used dry and can easily drift to non-target sites.

vii. Granule or Pellet Formulations

In some instances, the composition is formulated as granules. Granular formulations are similar to dust formulations, except granular particles are larger and heavier. In embodiments, the coarse particles are made from materials such as clay, corncobs, or walnut shells. The active ingredient either coats the outside of the granules or is absorbed into them. In embodiments, the amount of active ingredient is relatively low, usually ranging from about 0.5 to about 15 percent by weight. Granular formulations are most often used to apply to the soil, insects or nematodes living in the soil, or absorption into plants through the roots. Granular formulations are sometimes applied by airplane or helicopter to minimize drift or to penetrate dense vegetation. Once applied, granules can release the active ingredient slowly. Some granules require soil moisture to release the active ingredient. Granular formulations also are used to control larval mosquitoes and other aquatic pests. Granules are used in agricultural, structural, ornamental, turf, aquatic, right-of-way, and public health (biting insect) pest-control operations.

In some instances, the composition is formulated as pellets. Most pellet formulations are very similar to granular formulations; the terms are used interchangeably. In a pellet formulation, however, all the particles are the same weight and shape. The uniformity of the particles allows use with precision application equipment.

viii. Powders

In some instances, the composition is formulated as a powder. In some instances, the composition is formulated as a wettable powder. Wettable powders are dry, finely ground formulations that look like dusts. They usually must be mixed with water for application as a spray. A few products, however, can be applied either as a dust or as a wettable powder—the choice is left to the applicator. Wettable powders have about 1 to about 95 percent active ingredient by weight; in some cases, more than about 50 percent. The particles do not dissolve in water. They settle out quickly unless constantly agitated to keep them suspended. They can be used for most pest problems and in most types of spray equipment where agitation is possible. Wettable powders have excellent residual activity. Because of their physical properties, most of the formulation remains on the surface of treated porous materials such as concrete, plaster, and untreated wood. In such cases, only the water penetrates the material.

In some instances, the composition is formulated as a soluble powder. Soluble powder formulations look like wettable powders. However, when mixed with water, soluble powders dissolve readily and form a true solution. After they are mixed thoroughly, no additional agitation is necessary. The amount of active ingredient in soluble powders ranges from about 15 to about 95 percent by weight; in some cases, more than about 50 percent. Soluble powders have all the advantages of wettable powders and none of the disadvantages, except the inhalation hazard during mixing.

In some instances, the composition is formulated as a water-dispersible granule. Water-dispersible granules, also known as dry flowables, are like wettable powders, except instead of being dust-like, they are formulated as small, easily measured granules. Water-dispersible granules must be mixed with water to be applied. Once in water, the granules break apart into fine particles similar to wettable powders. The formulation requires constant agitation to keep it suspended in water. The percentage of active ingredient is high, often as much as 90 percent by weight. Water-dispersible granules share many of the same advantages and disadvantages of wettable powders, except they are more easily measured and mixed. Because of low dust, they cause less inhalation hazard to the applicator during handling.

In some embodiments, the composition comprises a solid excipient. Solid excipients include finely-divided powder or granules of clay (e.g. kaolin clay, diatomaceous earth, bentonite, Fubasami clay, acid clay, etc.), synthetic hydrated silicon oxide, talc, ceramics, other inorganic minerals (e.g., sericite, quartz, sulfur, activated carbon, calcium carbonate, hydrated silica, etc.), a substance which can be sublimated and is in the solid form at room temperature (e.g., 2,4,6-triisopropyl-1,3,5-trioxane, naphthalene, p-dichlorobenzene, camphor, adamantan, etc.); wool; silk; cotton; hemp; pulp; synthetic resins (e.g., polyethylene resins such as low-density polyethylene, straight low-density polyethylene and high-density polyethylene; ethylene-vinyl ester copolymers such as ethylene-vinyl acetate copolymers; ethylene-methacrylic acid ester copolymers such as ethylene-methyl methacrylate copolymers and ethylene-ethyl methacrylate copolymers; ethylene-acrylic acid ester copolymers such as ethylene-methyl acrylate copolymers and ethylene-ethyl acrylate copolymers; ethylene-vinylcarboxylic acid copolymers such as ethylene-acrylic acid copolymers; ethylene-tetracyclododecene copolymers; polypropylene resins such as propylene homopolymers and propylene-ethylene copolymers; poly-4-methylpentene-1, polybutene-1, polybutadiene, polystyrene; acrylonitrile-styrene resins; styrene elastomers such as acrylonitrile-butadiene-styrene resins, styrene-conjugated diene block copolymers, and styrene-conjugated diene block copolymer hydrides; fluororesins; acrylic resins such as poly(methyl methacrylate); polyamide resins such as nylon 6 and nylon 66; polyester resins such as polyethylene terephthalate, polyethylene naphthalate, polybutylene terephthalate, and polycyclohexylenedimethylene terephthalate; polycarbonates, polyacetals, polyacrylsulfones, polyarylates, hydroxybenzoic acid polyesters, polyetherimides, polyester carbonates, polyphenylene ether resins, polyvinyl chloride, polyvinylidene chloride, polyurethane, and porous resins such as foamed polyurethane, foamed polypropylene, or foamed ethylene, etc.), glasses, metals, ceramics, fibers, cloths, knitted fabrics, sheets, papers, yarn, foam, porous substances, and multifilaments.

ix. Nanocapsules/Microencapsulation/Liposomes

In some instances, the composition is provided in a microencapsulated formulation. Microencapsulated formulations are mixed with water and sprayed in the same manner as other sprayable formulations. After spraying, the plastic coating breaks down and slowly releases the active ingredient.

In some instances, the composition is provided in a liposome. In some instances, the composition is provided in a vesicle.

x. Surfactants

In some instances, the composition provided herein includes a surfactant. Surfactants, also called wetting agents and spreaders, physically alter the surface tension of a spray droplet. For a formulation to perform its function properly, a spray droplet must be able to wet the foliage and spread out evenly over a leaf. Surfactants enlarge the area of formulation coverage, thereby increasing exposure to the active agent. Surfactants are particularly important when applying a formulation to waxy or hairy leaves. Without proper wetting and spreading, spray droplets often run off or fail to cover leaf surfaces adequately. Too much surfactant, however, can cause excessive runoff and reduce efficacy.

Surfactants are classified by the way they ionize or split apart into electrically charged atoms or molecules called ions. A surfactant with a negative charge is anionic. One with a positive charge is cationic, and one with no electrical charge is nonionic. Formulation activity in the presence of a nonionic surfactant can be quite different from activity in the presence of a cationic or anionic surfactant. Selecting the wrong surfactant can reduce the efficacy of a product and injure the target plant. Anionic surfactants are most effective when used with contact pesticides (pesticides that control a pest by direct contact rather than being absorbed systemically). Cationic surfactants should never be used as stand-alone surfactants because they usually are phytotoxic.

Nonionic surfactants, often used with systemic pesticides, help sprays penetrate plant cuticles. Nonionic surfactants are compatible with most pesticides, and most EPA-registered pesticides that require a surfactant recommend a nonionic type. Adjuvants include, but are not limited to, stickers, extenders, plant penetrants, compatibility agents, buffers or pH modifiers, drift control additives, defoaming agents, and thickeners.

Among nonlimiting examples of surfactants included in the compositions described herein are alkyl sulfate ester salts, alkyl sulfonates, alkyl aryl sulfonates, alkyl aryl ethers and polyoxyethylenated products thereof, polyethylene glycol ethers, polyvalent alcohol esters and sugar alcohol derivatives. In some embodiments, the surfactant is a nonionic surfactant, a surfactant plus nitrogen source, an organo-silicone surfactant, or a high surfactant oil concentrate.

xi. Combinations

In formulations and in the use, forms prepared from these formulations, the recombinant polynucleotide can, in embodiments, be in a mixture with other active compounds, such as pesticidal agents (e.g., insecticides, sterilants, acaricides, nematicides, molluscicides, fungicides, attractants, pheromones, growth-regulating substances, or herbicides. As used herein, the term "pesticidal agent" refers to any substance or mixture of substances intended for preventing, destroying, repelling, or controlling or mitigating any pest. A pesticide can be a chemical substance or biological agent used against pests including insects, mollusks, pathogens, weeds, nematodes, and microbes that compete with humans for food, destroy property, spread disease, or are a nuisance. The term "pesticidal agent" further encompasses other bioactive molecules such as antibiotics, antivirals pesticides, antifungals, antihelminthics, nutrients, pollen, sucrose, and/or agents that stun or slow insect movement.

In instances where the recombinant polynucleotide is applied to plants, a mixture with other known compounds, such as herbicides, fertilizers, growth regulators, safeners, semiochemicals, or else with agents for improving plant properties is also possible.

EMBODIMENTS

Various embodiments of the compositions, systems, and methods described herein are set forth in the following set of numbered embodiments.

1. A recombinant DNA molecule comprising a heterologous promoter that is functional in a cell and is operably linked to a DNA sequence encoding an RNA molecule, wherein the RNA molecule comprises, in 5' to 3' order: (a) a 5' replicase recognition sequence that is capable of being recognized by an endornaviral RNA-dependent RNA polymerase (RDRP); (b) a cargo RNA sequence; and (c) a 3' replicase recognition sequence that is capable of being recognized by the endornaviral RDRP; wherein the RNA molecule optionally further comprises at least one additional element selected from the group consisting of: (d) at least one RNA encoding a viral movement protein (MP); (e) at least one tRNA-like sequence; and (f) an encapsidation recognition sequence (ERS).

2. The recombinant DNA molecule of embodiment 1, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

3. The recombinant DNA molecule of embodiment 1 or 2, wherein: (a) the 5' replicase recognition sequence comprises an RNA sequence encoded by at least one of SEQ ID Nos: 1-19, 372-405, 465, or 483-485, or the RNA sequence of SEQ ID NO: 580, or an RNA having at least 80%, 85%, 90%, 95%, 97%, 98%, or 99% sequence identity thereto; (b) the 3' replicase recognition sequence comprises an RNA sequence encoded by at least one of SEQ ID Nos: 20-38, 406-454, 467, or 486-488, or an RNA of SEQ ID NO: 581, or an RNA sequence having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

4. The recombinant DNA molecule of any one of embodiments 1-3, wherein: (a) the 5' replicase recognition sequence is derived from an endornavirus; (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

5. The recombinant DNA molecule of embodiment 4, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, are obtained from endornaviral genomes having at least 85%, 90%, 95%, 98%, or 99% sequence identity to one another, or are obtained from two endornaviral genomes wherein the members of each pair of the 5' RNA replicase recognition sequences, the 3' RNA replicase recognition sequences, and/or the RDRP coding sequences have at least 85%, 90%, 95%, 98%, or 99% sequence identity to one another.

6. The recombinant DNA molecule of any one of embodiments 1-5, wherein the cell is a bacterial cell, a plant cell, a fungal cell, or an animal cell.

7. The recombinant DNA molecule of embodiment 4 or 5, wherein the 5' replicase recognition sequence comprises a 5' UTR sequence of the endornavirus.

8. The recombinant DNA molecule of embodiment 7, wherein the 5' replicase recognition sequence further comprises a genomic sequence of the endornavirus that is natively located 3' to and adjacent to the 5' UTR sequence.

9. The recombinant DNA molecule of embodiment 4 or 5, wherein the 3' replicase recognition sequence comprises a 3' UTR sequence of the endornavirus.

10. The recombinant DNA molecule of embodiment 9, wherein the 3' replicase recognition sequence further comprises a genomic sequence of the endornavirus that is natively located 5' to and adjacent to the 3' UTR sequence.

11. The recombinant DNA molecule of any one of embodiments 1-10, wherein the RNA molecule further comprises at least one RNA sequence encoding a viral MP, and wherein the at least one RNA sequence encoding an MP is located (a) before the cargo RNA sequence, (b) after the cargo RNA sequence, or (c) both before and after the cargo RNA sequence.

12. The recombinant DNA molecule of embodiment 11, wherein the at least one RNA sequence encoding an MP comprises at least two RNA sequences encoding different MPs or a single RNA sequence encoding multiple copies of MPs.

13. The recombinant DNA molecule of any one of embodiments 1-12, further comprising a discrete expression cassette comprising a second promoter that is functional in the cell and is operably linked to a DNA sequence encoding at least one viral movement protein, and optionally a terminator element.

14. The recombinant DNA molecule of any one of embodiments 1-13, wherein the RNA molecule further comprises an ERS, wherein the ERS is located close to or adjacent to the 3' replicase recognition sequence, optionally wherein the 3' replicase recognition sequence comprises a 3' UTR sequence of the endornavirus.

15. The recombinant DNA molecule of embodiment 14, wherein the ERS comprises a viral origin-of-assembly sequence (OAS).

16. The recombinant DNA molecule of embodiment 15, wherein the viral OAS sequence is a tobacco mosaic virus OAS (TMV-OAS).

17. The recombinant DNA molecule of any one of embodiments 1-16, wherein the RNA molecule further comprises at least one tRNA-like sequence, and wherein the at least one tRNA-like sequence comprises a tRNA-like sequence from an *Arabidopsis* FT mRNA, or comprises at least one tRNA-like sequence selected from the group consisting of an RNA sequence encoded by a DNA sequence of SEQ ID Nos:114-160, and 161.

18. The recombinant DNA molecule of any one of embodiments 1-17, wherein the RNA molecule further comprises at least one RNA encoding a viral MP, a tRNA-like sequence from an *Arabidopsis* FT mRNA, and an encapsidation recognition sequence comprising TMV-OAS.

19. The recombinant DNA molecule of any one of embodiments 1-18, wherein the cargo RNA sequence is up to about 14 kb in length.

20. The recombinant DNA molecule of any one of embodiments 1-19, wherein the cargo RNA sequence comprises: (a) at least one coding sequence, (b) at least one non-coding sequence, or (c) both at least one coding sequence and at least one non-coding sequence.

21. The recombinant DNA molecule of any one of embodiments 1-20, wherein the cargo RNA sequence comprises at least one coding sequence, and wherein the RNA molecule further comprises an internal ribosome entry site (IRES) located 5' and immediately adjacent to the at least one coding sequence.

22. The recombinant DNA molecule of any one of embodiments 1-21, wherein the cargo RNA sequence comprises multiple coding sequences, and wherein the RNA molecule further comprises an IRES located 5' and immediately adjacent to each of the coding sequences.

23. The recombinant DNA molecule of any one of embodiments 1-22, wherein the cargo RNA sequence comprises at least one non-coding sequence, and wherein the at least one non-coding sequence is selected from the group consisting of a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; and a long noncoding RNA (lncRNA).

24. The recombinant DNA molecule of any one of embodiments 1-23, further comprising a DNA sequence encoding at least one self-cleaving ribozyme.

25. The recombinant DNA molecule of embodiment 24, wherein the at least one self-cleaving ribozyme is located 5' to the 5' replicase recognition sequence or 3' to the 3' replicase recognition sequence.

26. The recombinant DNA molecule of any one of embodiments 1-25, further comprising a DNA sequence encoding at least one ligand-responsive self-cleaving ribozyme (aptazyme).

27. The recombinant DNA molecule of embodiment 26, wherein the at least one ligand-responsive self-cleaving ribozyme is located 5' to the 5' replicase recognition sequence or 3' to the 3' replicase recognition sequence.

28. The recombinant DNA molecule of any one of embodiments 1-27, further comprising an intronic sequence.

29. The recombinant DNA molecule of any one of embodiments 1-28, further comprising at least one additional element selected from the group consisting of: (a) a discrete expression cassette comprising a second promoter operably linked to a DNA sequence to be transcribed, and optionally a terminator element; (b) an expression-enhancing element; (c) a DNA sequence encoding a marker; (d) a DNA aptamer; (e) a DNA sequence encoding an RNA aptamer; (f) T-DNA left and right border DNA sequences; (g) spacer DNA sequence; (h) a DNA sequence encoding a transcription factor binding site; (i) a DNA sequence encoding a localization sequence; (j) a DNA sequence encoding at least one sequence-specific recombinase recognition site; and (k) a DNA sequence encoding a transcript-stabilizing or transcript-destabilizing sequence.

30. The RNA molecule produced by expressing the recombinant DNA molecule of any one of embodiments 1-29.

31. A cell comprising the recombinant DNA molecule of any one of embodiments 1-29.

32. The cell of embodiment 31, wherein the cell is a prokaryotic cell or a eukaryotic cell.

33. A vector for bacterially mediated plant transformation, comprising the recombinant DNA molecule of any one of embodiments 1-29.

34. The vector of embodiment 33, wherein the bacterium that mediates the plant transformation is *Agrobacterium*, and wherein the vector further comprises T-DNAs flanking the DNA molecule encoding the recombinant RNA molecule.

35. The vector of embodiment 33 or 34, contained within a plant cell.

36. An expression system comprising: (a) a recombinant DNA molecule comprising a heterologous promoter that is functional in a cell and is operably linked to a DNA sequence encoding an RNA molecule comprising, in 5' to 3' order: (i) a 5' replicase recognition sequence that is capable of being recognized by an endornaviral RDRP; (ii) a cargo RNA sequence; and (iii) a 3' replicase recognition sequence that is capable of being recognized by the endornaviral RDRP; and, optionally, further comprising at least one additional element selected from the group consisting of: (iv) at least one RNA encoding a viral movement protein (MP); (v) at least one tRNA-like sequence; and (vi) an encapsidation recognition sequence; and (b) a cell containing an RDRP protein that recognizes 5' and 3' replicase recognition sequences derived from an endornavirus.

37. The expression system of embodiment 36, wherein: (i) the 5' replicase recognition sequence comprises at least one secondary structure provided in Table 8, 9, or 10; and/or (ii) the 3' replicase recognition sequence comprises at least one secondary structure provided in Table 11, 12, or 13.

38. The expression system of embodiment 36 or 37, wherein: (i) the 5' replicase recognition sequence comprises an RNA sequence encoded by at least one of SEQ ID Nos: 1-19, 372-405, 465, or 483-485, or the RNA sequence of SEQ ID NO:580, or an RNA having at least 80%, 85%, 90%, 95%, 97%, 98%, or 99% sequence identity thereto; and/or (ii) the 3' replicase recognition sequence comprises an RNA encoded by at least one of SEQ ID Nos: 20-38, 406-454, 467, or 486-488, or the RNA sequence of SEQ ID NO: 581, or an RNA having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

39. The expression system of any one of embodiments 36-38, wherein: (i) the 5' replicase recognition sequence is derived from an endornavirus; and/or (ii) the 3' replicase recognition sequence is derived from an endornavirus.

40. The expression system of embodiment 39, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, are obtained from endornaviral genomes having at least 85%, 90%, 95%, 98%, or 99% sequence identity to one another, or are obtained from two endornaviral genomes wherein the members of each pair of the 5' RNA replicase recognition sequences, the 3' RNA replicase recognition sequences, and/or the RDRP coding sequences have at least 85%, 90%, 95%, 98%, or 99% sequence identity to one another.

41. The expression system of any one of embodiments 36-40, wherein the cell is a bacterial cell, a plant cell, a fungal cell, or an animal cell.

42. The expression system of any one of embodiments 36-41, further comprising a viral coat protein that is recognized by the encapsidation recognition sequence and encapsidates the RNA molecule.

43. The expression system of embodiment 42, wherein the viral coat protein is: (a) expressed by the recombinant DNA molecule in the cell, (b) co-expressed by a second recombinant DNA molecule in the cell; (c) provided exogenously to the cell; or (d) expressed by a virus in the cell.

44. The expression system of any one of embodiments 36-43, wherein the RDRP protein is heterologous to the cell.

45. The expression system of any one of embodiments 36-43, wherein the RDRP protein is provided exogenously to the cell.

46. The expression system of any one of embodiments 36-45, wherein the cell is a plant cell.

47. The expression system of embodiment 46, wherein the RDRP protein that recognizes the 5' and 3' replicase recognition sequences is endogenously expressed in the plant cell by the endornavirus.

48. The expression system of embodiment 46 or 47, wherein the endornavirus occurs naturally in the plant cell.

49. The expression system of any one of embodiments 36-48, wherein the recombinant DNA molecule further comprises at least one RNA encoding a viral MP, a tRNA-like sequence from an *Arabidopsis* FT mRNA, and an encapsidation recognition sequence comprising TMV-OAS.

50. An agricultural formulation comprising the expression system of any one of embodiments 36-49.

51. A recombinant RNA molecule comprising, in 5' to 3' order: (a) a 5' replicase recognition sequence that is capable of being recognized by an endornaviral RDRP; (b) a cargo RNA sequence; and (c) a 3' replicase recognition sequence that is capable of being recognized by the endornaviral RDRP; optionally wherein the cargo RNA sequence is heterologous to the 5' replicase recognition sequence and/or to the 3' replicase recognition sequence; and, optionally, that further comprises at least one additional element selected from the group consisting of: (d) at least one RNA encoding a viral movement protein ("MP"); (e) at least one tRNA-like sequence; and (f) an origin-of-assembly sequence ("OAS").

52. The recombinant RNA molecule of embodiment 51, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

53. The recombinant RNA molecule of embodiment 51 or 52, wherein: (a) the 5' replicase recognition sequence comprises an RNA sequence encoded by at least one of SEQ ID Nos: 1-19, 372-405, 465, or 483-485, or the RNA sequence of SEQ ID NO:580, or an RNA sequence having at least 80%, 85%, 90%, 95%, 97%, 98%, or 99% sequence identity thereto; (b) the 3' replicase recognition sequence comprises an RNA sequence encoded by at least one of SEQ ID Nos: 20-38, 406-454, 467, 486-488, or the RNA sequence of SEQ ID NO: 581, or an RNA sequence having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

54. The recombinant RNA molecule of any one of embodiments 51-53, wherein: (a) the 5' replicase recognition sequence is derived from an endornavirus; and/or (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

55. The recombinant RNA molecule of embodiment 54, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, or are obtained from endornaviral genomes having at least 85%, 90%, 95%, 98%, or 99% sequence identity to one another; and, optionally, wherein the endornaviral RNA-dependent RNA polymerase is derived from the same endornavirus, or are optionally obtained from endornaviral genomes wherein the 5' RNA replicase recognition sequence, the 3' RNA replicase recognition sequence, and/or the RDRP have at least 85%, 90%, 95%, 98%, or 99% sequence identity to the corresponding 5' RNA replicase recognition sequence, 3' RNA replicase recognition sequence, and/or RDRP.

56. The recombinant RNA molecule of any one of embodiments 51-55, encapsidated by a viral coat protein.

57. The recombinant RNA molecule of embodiment 56, wherein the viral coat protein is heterologous to the endornavirus.

58. An agricultural formulation comprising the recombinant RNA molecule of any one of embodiments 51-57.

59. The agricultural formulation of embodiment 58, wherein the recombinant RNA molecule further comprises an encapsidation recognition sequence.

60. The agricultural formulation of embodiment 59, wherein the synthetic endornaviral satellite RNA comprising the encapsidation recognition sequence is encapsidated by a viral coat protein recognized by the encapsidation recognition sequence.

61. A cell comprising the recombinant RNA molecule of any one of embodiments 51-57.

62. The cell of embodiment 61, wherein the cell is a bacterial cell, a fungal cell, a plant cell, or an animal cell.

63. A method of providing a synthetic endornaviral satellite RNA to a plant cell, comprising: providing to a plant cell a recombinant RNA molecule comprising, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant cell comprises an RDRP protein that recognizes the 5' replicase recognition sequence and 3' replicase recognition sequence, whereby the RDRP protein catalyzes synthesis of the synthetic endornaviral satellite RNA from the recombinant RNA molecule.

64. The method of embodiment 63, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

65. The method of embodiment 63 or 64, wherein: (a) the 5' replicase recognition sequence comprises at least one of an RNA sequence encoded by a DNA sequence of SEQ ID Nos: 1-19, 372-405, 465, or 483-485, or the RNA sequence of SEQ ID NO:580, or an RNA sequence having at least 80%, 85%, 90%, 95%, 97%, 98%, or 99% sequence identity thereto; (b) the 3' replicase recognition sequence comprises at least one of an RNA sequence encoded by a DNA sequence of SEQ ID Nos: 20-38, 406-454, 467, or 486-488, or the RNA sequence of SEQ ID NO: 581, or an RNA sequence having at least 80%, 85%, 90%, 95%, 97%, 98%, or 99% sequence identity thereto; or (c) the endornaviral RDRP comprises a polypeptide having at least 85%, 90%, 95%, 98%, or 99% sequence identity to any one of SEQ ID NO: 355-371, 456, or 534-577.

66. The method of any one of embodiments 63-65, wherein: (a) the 5' replicase recognition sequence is derived from an endornavirus; (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

67. The method of embodiment 66, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, or are obtained from endornaviral genomes having at least 85%, 90%, 95%, 98%, or 99% sequence identity to one another; and, optionally, wherein the endornaviral RNA-dependent RNA polymerase is derived from the same endornavirus or are optionally obtained from endornaviral genomes wherein the 5' RNA replicase recognition sequence, the 3' RNA replicase recognition sequence, and/or the RDRP have at least 85%, 90%, 95%, 98%, or 99% sequence identity to the corresponding 5' RNA replicase recognition sequence, 3' RNA replicase recognition sequence, and/or RDRP.

68. The method of embodiment 67, wherein the plant cell comprises the endornavirus, and wherein the RDRP protein is provided to the plant cell by the endornavirus.

69. The method of embodiment 68, wherein the endornavirus is endemic to the plant cell, optionally wherein the endemic endornavirus is non-pathogenic and/or commensal.

70. The method of embodiment 69, wherein the endornavirus is exogenously provided to the plant cell, optionally wherein the endornavirus is endemic or native to a different species, variety, or germplasm.

71. The method of embodiment 68, wherein the RDRP protein is exogenously provided to the plant cell.

72. The method of any one of embodiment 63-71, wherein the recombinant RNA molecule has been produced in a fermentation system.

73. The method of any one of embodiments 63-72, wherein the synthetic endornaviral satellite RNA is provided to the plant cell by transcribing in the plant cell a recombinant DNA construct comprising a promoter functional in the plant cell and operably linked to a DNA sequence encoding the recombinant RNA molecule.

74. The method of any one of embodiments 63-73, wherein the recombinant RNA molecule further comprises an encapsidation recognition sequence, and wherein the plant cell further comprises a viral coat protein capable of encapsidating the synthetic endornaviral satellite RNA.

75. The method of embodiment 74, wherein the viral coat protein is exogenously provided to the plant cell.

76. The method of any one of embodiments 73-75, wherein the recombinant DNA construct further comprises a DNA sequence encoding a viral coat protein.

77. The method of embodiment 76, wherein the recombinant DNA construct further comprises a second promoter functional in the plant cell and operably linked to the DNA sequence encoding the viral plant protein.

78. The method of embodiment 77, wherein the viral coat protein is expressed in the plant cell and encapsidates the synthetic endornaviral satellite RNA.

79. The method of any one of embodiments 63-78, wherein the plant cell comprises the endornavirus, and wherein the endornavirus provides the plant cell the RDRP protein.

80. A method of obtaining a phenotypic change in a plant or plant cell, comprising: providing to a plant or plant cell a recombinant RNA molecule comprising, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the cargo RNA sequence comprises RNA that effects a phenotypic change in the plant or plant cell; wherein the plant or plant cell comprises an RDRP protein that recognizes the 5' replicase recognition sequence and 3' replicase recognition sequence, whereby the RDRP protein catalyzes synthesis of a synthetic endornaviral satellite RNA from the recombinant RNA molecule and the cargo RNA sequence effects the phenotypic change.

81. The method of embodiment 80, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

82. The method of embodiment 80 or 81, wherein: (a) the 5' replicase recognition sequence comprises at least one of an RNA sequence encoded by SEQ ID NOs: 1-19, 372-405, 465, or 483-485, or the RNA sequence of SEQ ID NO:580, or an RNA sequence having at least 80%, 85%, 90%, 95%, 97%, 98%, or 99% sequence identity thereto; (b) the 3' replicase recognition sequence comprises an RNA sequence encoded by at least one of SEQ ID NOs: 20-38, 406-454, 467, 486-488, 467, or 486-488, or the RNA sequence of SEQ ID NO: 581, or an RNA sequence having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

83. The method of any one of embodiments 80-82, wherein: (a) the 5' replicase recognition sequence is derived from an endornavirus; (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

84. The method of embodiment 83, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, or are obtained from endornaviral genomes having at least 85%, 90%, 95%, 98%, or 99% sequence identity to one another; and, optionally, wherein the endornaviral RNA-dependent RNA polymerase is derived from the same endornavirus or are optionally obtained from endornaviral genomes wherein the 5' RNA replicase recognition sequence, the 3' RNA replicase recognition sequence, and/or the RDRP have at least 85%, 90%, 95%, 98%, or 99% sequence identity to the corresponding 5' RNA replicase recognition sequence, 3' RNA replicase recognition sequence, and/or RDRP.

85. The method of any one of embodiments 80-84, wherein the RNA that effects a phenotypic change in the plant or plant cell comprises an RNA for modulating a target gene's expression relative to the target gene's expression in a control plant or plant cell not provided with the recombinant RNA molecule, and wherein the phenotypic change is a result of the modulation.

86. The method of embodiment 85, wherein the modulation is (a) an increase of the target gene's expression; or (b) a decrease of the target gene's expression.

87. The method of embodiment 85, wherein the RNA that effects a phenotypic change in the plant or plant cell suppresses the target gene's expression.

88. The method of any one of embodiments 80-87, wherein the RNA that effects a phenotypic change in the plant or plant cell comprises at least one RNA selected from an siRNA or siRNA precursor, a miRNA or miRNA precursor, and a phased siRNA or phased siRNA precursor.

89. The method of any one of embodiments 80-87, wherein the RNA that effects a phenotypic change in the plant or plant cell comprises a messenger RNA.

90. The method of embodiment 89, wherein the messenger RNA comprises an RNA sequence absent in the genome of the plant or plant cell.

91. The method of any one of embodiments 80-87, wherein the RNA that effects a phenotypic change in the plant or plant cell comprises an RNA for modifying the genome of the plant or plant cell.

92. The method of any one of embodiments 83-91, wherein the plant cell comprises the endornavirus, and wherein the RDRP protein is provided to the plant cell by the endornavirus.

93. The method of embodiment 92, wherein the endornavirus is endemic to the plant cell, optionally wherein the endemic endornavirus is non-pathogenic and/or commensal.

94. The method of embodiment 92, wherein the endornavirus is exogenously provided to the plant cell, optionally wherein the endornavirus is endemic or native to a different species, variety, or germplasm.

95. The method of any one of embodiments 80-91, wherein the RDRP protein is exogenously provided to the plant cell.

96. The method of embodiment 95, wherein the recombinant RNA molecule has been produced in a fermentation system.

97. The method of any one of embodiments 80-91, 95, and 96, wherein the recombinant RNA molecule is provided to the plant cell by transcribing in the plant cell a recombinant DNA construct comprising a promoter functional in the plant cell and operably linked to a DNA sequence encoding the recombinant RNA molecule.

98. The method of any one of embodiments 80-97, wherein the recombinant RNA molecule further comprises an encapsidation recognition sequence, and wherein the plant cell further comprises a viral coat protein capable of encapsidating the synthetic endornaviral satellite RNA.

99. The method of embodiment 98, wherein the viral coat protein is exogenously provided to the plant cell.

100. The method of any one of embodiments 80-99, wherein the recombinant DNA construct further comprises a DNA sequence encoding a viral coat protein.

101. The method of embodiment 100, wherein the recombinant DNA construct further comprises a second promoter functional in the plant cell and operably linked to the DNA sequence encoding the viral coat protein.

102. The method of any one of embodiments 98-101, wherein the viral coat protein is expressed in the plant cell and encapsidates the synthetic endornaviral satellite RNA.

103. The method of any one of embodiments 80-91, wherein the plant cell comprises the endornavirus, and wherein the endornavirus provides the plant cell the RDRP protein.

104. The method of any one of embodiments 80-103, wherein the recombinant RNA molecule is provided to the plant cell by contacting the plant cell with a formulation comprising the recombinant RNA molecule, wherein the recombinant RNA molecule has been produced in a fermentation system, wherein the recombinant RNA molecule is optionally encapsidated by a viral coat protein.

105. A method of increasing a plant's resistance and/or tolerance to a pest or pathogen, comprising: providing a plant with a recombinant RNA molecule comprising, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the cargo RNA sequence effects an increase in the plant's resistance and/or tolerance to a pest or pathogen, relative to that in a plant not provided with the recombinant RNA molecule, wherein the plant or plant cell comprises an RDRP protein that recognizes the 5' replicase recognition sequence and 3' replicase recognition sequence, whereby the RDRP protein catalyzes synthesis of a synthetic endornaviral satellite RNA from the recombinant RNA molecule.

106. The method of embodiment 105, wherein the pest or pathogen is selected from the group comprising: a bacterium, a fungus, an oomycete, and an invertebrate, optionally wherein the fungus is a *Botrytis* sp.

107. A method of increasing a plant's resistance to stress, comprising: providing a plant with a recombinant RNA molecule comprising, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant or plant cell comprises an RDRP protein that recognizes the 5' replicase recognition sequence and 3' replicase recognition sequence, whereby the RDRP protein catalyzes synthesis of the synthetic endornaviral satellite RNA from the recombinant RNA molecule and wherein the cargo RNA sequence effects an increase in the plant's resistance to stress, relative to that in a plant not provided with the recombinant RNA molecule.

108. The method of embodiment 107, wherein the stress comprises at least one abiotic stress selected from the group comprising: nutrient stress, light stress, water stress, heat stress, and cold stress.

109. The method of embodiment 107 or 108, wherein the stress comprises at least one biotic stress selected from the group comprising: crowding, shading, and allelopathy.

110. A method of expressing an exogenous polypeptide in a plant or plant cell, comprising: expressing in a plant or plant cell a recombinant DNA molecule comprising a heterologous promoter that is functional in the plant or plant cell and is operably linked to a DNA sequence encoding an RNA molecule that comprises, in 5' to 3' order: (a) a 5' replicase recognition sequence that is capable of being recognized by an endornaviral RDRP; (b) a cargo RNA sequence comprising a translatable messenger RNA encoding an exogenous polypeptide; and (c) a 3' replicase recognition sequence that is capable of being recognized by the endornaviral RDRP; wherein the RNA molecule optionally further comprises at least one additional element selected from the group consisting of: (d) at least one RNA encoding a viral movement protein ("MP"); (e) at least one tRNA-like sequence; and (f) an encapsidation recognition sequence, wherein the plant or plant cell comprises an RDRP protein that recognizes the 5' replicase recognition sequence and 3' replicase recognition sequence, whereby the RDRP protein catalyzes synthesis of a synthetic endornaviral satellite RNA from the recombinant RNA molecule and wherein the exogenous polypeptide is translated from the translatable messenger RNA encoding an exogenous polypeptide.

111. The method of any one of embodiments 105-110, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

112. The method of any one of embodiments 105-111, wherein: (a) the 5' replicase recognition sequence comprises an RNA sequence encoded by at least one of SEQ ID NOs: 1-19, 372-405, 465, or 483-485, or the RNA sequence of SEQ ID NO:580, or an RNA sequence having at least 80%, 85%, 90%, 95%, 97%, 98%, or 99% sequence identity thereto; (b) the 3' replicase recognition sequence comprises an RNA sequence encoded by at least one of SEQ ID NOs: 20-38, 406-454, 467, or 486-488, or the RNA sequence of SEQ ID NO: 581, or an RNA sequence having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

113. The method of any one of embodiments 105-112, wherein: (a) the 5' replicase recognition sequence is derived from an endornavirus; (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

114. The method of embodiment 113, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, or are obtained from endornaviral genomes having at least 85%, 90%, 95%, 98%, or 99% sequence identity to one another; and, optionally, wherein the endornaviral RNA-dependent RNA polymerase is derived from the same endornavirus or are optionally obtained from endornaviral genomes wherein the 5' RNA replicase recognition sequence, the 3' RNA replicase recognition sequence, and/or the RDRP have at least 85%, 90%, 95%, 98%, or 99% sequence identity to the corresponding 5' RNA replicase recognition sequence, 3' RNA replicase recognition sequence, and/or RDRP.

115. A method of manufacturing a synthetic endornaviral satellite particle, comprising: (a) providing to a plant cell a recombinant RNA molecule comprising, in 5' to 3' order, a 5' replicase recognition sequence that is capable of being recognized by an endornaviral RDRP; a cargo RNA sequence; and a 3' replicase recognition sequence that is capable of being recognized by the endornaviral RDRP, wherein the plant cell comprises an RDRP protein that recognizes the 5' replicase recognition sequence and 3' replicase recognition sequence, whereby the RDRP protein catalyzes synthesis of a synthetic endornaviral satellite RNA from the recombinant RNA molecule; and (b) encapsidating the synthetic endornaviral satellite RNA with a viral coat protein, thereby providing a synthetic endornaviral satellite particle.

116. The method of embodiment 115, wherein the viral coat protein is exogenously provided to the plant cell.

117. The method of embodiment 115, wherein the plant cell further comprises the viral coat protein.

118. The method of embodiment 115, wherein the viral coat protein is recombinantly expressed in the plant cell.

119. The method of any one of embodiments 115-118, wherein the cargo RNA sequence is up to about 14 kb in length.

120. The method of any one of embodiments 115-119, wherein the cargo RNA sequence comprises: (a) at least one coding sequence, (b) at least one non-coding sequence, or (c) both at least one coding sequence and at least one non-coding sequence.

121. The method of any one of embodiments 115-120, wherein the cargo RNA sequence comprises at least one coding sequence, and wherein the RNA molecule further comprises an IRES located 5' and immediately adjacent to the at least one coding sequence.

122. The method of any one of embodiments 115-121, wherein the cargo RNA sequence comprises multiple coding sequences, and wherein the RNA molecule further comprises an IRES located 5' and immediately adjacent to each of the coding sequences.

123. The method of any one of embodiments 115-122, wherein the cargo RNA sequence comprises at least one non-coding sequence, and wherein the at least one non-coding sequence is selected from the group consisting of a hairpin RNA (hpRNA); an RNA that forms multiple stem-loops; an RNA pseudoknot; an RNA sequence that forms at least partially double-stranded RNA; a small interfering RNA (siRNA) or siRNA precursor; a microRNA (miRNA) or miRNA precursor; a self-cleaving ribozyme; a ligand-responsive self-cleaving ribozyme (aptazyme); an RNA aptamer; and a long noncoding RNA (lncRNA).

124. The method of any one of embodiments 115-123, wherein the recombinant RNA molecule is provided to the plant cell by transcribing in the plant cell a recombinant DNA construct comprising a promoter functional in the plant cell and operably linked to a DNA sequence encoding the recombinant RNA molecule 125. The method of embodiment 124, wherein the recombinant DNA construct further comprises a DNA sequence encoding the viral coat protein.

126. The method of embodiment 124 or 125, wherein the recombinant DNA construct further comprises a second promoter functional in the plant cell and operably linked to the DNA sequence encoding the viral plant protein.

127. The method of any one of embodiments 115-126, wherein the plant cell comprises the endornavirus, and wherein the endornavirus provides the plant cell the RDRP protein.

128. The method of embodiment 127, wherein the endornavirus is endemic to the plant cell, optionally wherein the endemic endornavirus is non-pathogenic and/or commensal.

129. The method of embodiment 127, wherein the endornavirus is exogenously provided to the plant cell, optionally wherein the endornavirus is endemic or native to a different species, variety, or germplasm.

130. The method of embodiment 127, wherein the RDRP protein is exogenously provided to the plant cell.

131. The method of any one of embodiments 115-130, further comprising the step of isolating the synthetic endornaviral satellite particle.

132. The method of any one of embodiments 115-131, further comprising the step of purifying the synthetic endornaviral satellite particle.

133. The method of embodiment 131 or 132, further comprising the step of formulating the synthetic endornaviral satellite particle.

134. The synthetic endornaviral satellite particle provided by the method of any one of embodiments 115-133.

135. An agricultural formulation comprising the synthetic endornaviral satellite particle provided by the method of any one of embodiments 115-133.

136. A method of providing a synthetic endornaviral satellite particle to a plant, comprising contacting the plant with the synthetic endornaviral satellite particle of embodiment 134.

137. The method of embodiment 136, wherein contacting comprises spraying, dusting, injecting, or soaking.

138. The of any one of embodiments 115-137, wherein the cargo RNA sequence comprises at least one coding sequence encoding a polypeptide and is translated to produce the polypeptide in the plant.

139. A cell-free expression system comprising: (a) an RNA molecule comprising, in 5' to 3' order: (i) a 5' replicase recognition sequence derived from an endornavirus; (ii) a cargo RNA sequence; and (iii) a 3' replicase recognition sequence derived from the endornavirus; and, optionally, further comprising at least one additional element selected from the group consisting of: (iv) at least one RNA encoding a viral movement protein ("MP"); (v) at least one tRNA-like sequence; and (vi) an origin-of-assembly sequence ("OAS"); and (b) an RDRP protein that recognizes the 5' and 3' replicase recognition sequences from a endornavirus.

140. The expression system of embodiment 139, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

141. The expression system of embodiment 139 or 140, wherein: (a) the 5' replicase recognition sequence comprises an RNA sequence encoded by at least one of SEQ ID NOs: 1-19, 372-405, 465, or 483-485, the RNA sequence of SEQ ID NO:580, or an RNA molecule having at least 80%, 85%, 90%, 95%, 97%, 98%, or 99% sequence identity thereto; (b) the 3' replicase recognition sequence comprises an RNA sequence encoded by at least one of SEQ ID NOs: 20-38, 406-454, 467, or 486-488, an RNA sequence of SEQ ID NO: 581, or an RNA sequence having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

142. The expression system of any one of embodiments 139-141, wherein: (a) the 5' replicase recognition sequence is derived from an endornavirus; (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

143. The expression system of embodiment 142, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, or are obtained from endornaviral genomes having at least 85%, 90%, 95%, 98%, or 99% sequence identity to one another; and, optionally, wherein the endornaviral RNA-dependent RNA polymerase is derived from the same endornavirus or are optionally obtained from endornaviral genomes wherein the 5' RNA replicase recognition sequence, the 3' RNA replicase recognition sequence, and/or the RDRP have at least 85%, 90%, 95%, 98%, or 99% sequence identity to the corresponding 5' RNA replicase recognition sequence, 3' RNA replicase recognition sequence, and/or RDRP.

144. The expression system of any one of embodiments 139-143, wherein the RDRP protein is provided by the endornavirus.

145. An agricultural formulation comprising the expression system of any one of embodiments 139-144.

146. A plant comprising the recombinant RNA molecule of any one of embodiments 30, or 51 to 57 and an endornaviral RDRP, optionally wherein the plant is a grafted plant and wherein the rootstock and/or scion of the grafted plant comprise at least one cell comprising the recombinant RNA and the endornaviral RDRP.

147. The plant of embodiment 146, wherein the plant is a monocot or a dicot plant.

148. The plant of embodiment 146 or 147, wherein the plant is of the family Asteraceae, Cucurbitaceae, Fabaceae, Lauraceae, Poaceae, or Solanaceae.

149. The plant of any one of embodiments 146-148, wherein the plant lacks DNA that encodes the recombinant RNA molecule.

150. The plant of any one of embodiments 146-149, wherein the plant comprises an endornavirus, and wherein the endornaviral RDRP is provided to the plant cell by the endornavirus.

151. The plant of any one of embodiments 146-150, wherein the endornavirus is endemic to the plant, optionally wherein the endemic endornavirus is non-pathogenic and/or commensal.

152. The plant of any one of embodiments 146-151, wherein the endornaviral RDRP, the 5' replicase recognition sequence, and/or the 3' replicase recognition sequence are derived from an endornavirus selected from the group consisting of Bell pepper Endornavirus (BPEV), *Phaseolus vulgaris* alphaendornavirus 1 (PvEV-1), *Phaseolus vulgaris* endornavirus 2 (PvEV-2), and *Helianthus annuus* alphaendornavirus isolate BJ.

153. A plant propagule comprising the recombinant RNA molecule of any one of embodiments 51-57 and an endornaviral RDRP.

154. The plant propagule of embodiment 153, wherein the plant propagule comprises a cell, or a seed, seedling, ovule, embryo, pollen, root, stem, leaf, shoot, tuber, rhizome, stolon, bulb, explant, or callus comprising the cell.

155. The plant propagule of embodiment 153 or 154, wherein the plant propagule is a mosaic comprising both plant cells comprising the recombinant RNA molecule and plant cells lacking the recombinant RNA molecule.

156. The plant propagule of any one of embodiments 153-155, wherein the plant propagule is a mosaic comprising both plant cells comprising the endornaviral RDRP and plant cells lacking the endornaviral RDRP.

157. The plant propagule of any one of embodiments 153-156, wherein the plant propagule lacks DNA that encodes the recombinant RNA molecule.

158. A method of producing a modified plant propagule that comprises at least one plant cell comprising a recombinant RNA molecule, comprising isolating a plant propagule comprising at least one plant cell comprising a recombinant RNA molecule and an endornaviral RNA-dependent RNA polymerase (RDRP) from a mixed population of plant cells comprising both plant cells comprising the recombinant RNA molecule and plant cells lacking the recombinant RNA molecule, wherein the recombinant RNA molecule comprises, in 5' to 3' order, a 5' replicase recognition sequence that is capable of being recognized by the endornaviral RDRP; a cargo RNA sequence; and a 3' replicase recognition sequence that is capable of being recognized by the endornaviral RDRP.

159. The method of embodiment 158, wherein the mixed population of plant cells comprise a population of protoplasts or a population of cells in callus or explant.

160. The method of embodiment 158 or 159, wherein the mixed population of plant cells comprise plant cells comprising the endornaviral RDRP and plant cells lacking the endornaviral RDRP.

161. The method of any one of embodiments 158-160, wherein the mixed population of plant cells comprise plant cells comprising the endornaviral RDRP.

162. The method of any one of embodiments 158-161, wherein the mixed population of plant cells is screened or selected for the presence of the plant cell comprising the recombinant RNA molecule prior to isolating the plant propagule.

163. The method of any one of embodiments 158-162, wherein the isolation comprises selecting for the plant cell comprising the recombinant RNA molecule prior to isolating the plant propagule.

164. The method of any one of embodiments 158-163, wherein the mixed population is located within a plant or a plant part.

165. The method of embodiment 164, wherein the plant or plant part is screened or selected for the presence of the recombinant RNA molecule prior to isolating the plant propagule.

166. The method of embodiment 164 or 165, wherein the plant or plant part is screened or selected for systemic presence of the recombinant RNA molecule prior to isolating the plant propagule.

167. The method of any one of embodiments 158-166, wherein the cargo RNA sequence comprises RNA that encodes a selectable or scorable marker.

168. The method of embodiment 167, wherein the selectable or scorable marker is an RNA aptamer or a regulatory RNA.

169. The method of embodiment 168, wherein the regulatory RNA is selected from the group consisting of an siRNA or siRNA precursor, a miRNA or a miRNA precursor, a trans-acting siRNA or trans-acting siRNA precursor, an siRNA or miRNA decoy, an siRNA or miRNA cleavage blocker, an siRNA or miRNA recognition and cleavage sequence, a riboswitch, and a ribozyme.

170. The method of embodiment 167 wherein the selectable marker or scorable marker is an RNA sequence encoding a polypeptide.

171. The method of embodiment 170, wherein the polypeptide confers resistance in a plant cell to an antibiotic or to an herbicide.

172. The method of any one of embodiments 158-171, wherein cargo RNA sequence comprises RNA that encodes a selectable marker and the plant propagule comprising the recombinant RNA molecule is isolated by selecting for presence of the selectable marker.

173. The method of embodiment 172, further comprising selecting a plant propagule comprising a recombinant RNA molecule wherein the selectable marker has been removed.

174. The method of any one of embodiments 158-173, wherein the plant propagule comprising the recombinant RNA molecule is isolated by detecting the RNA molecule in one or more plant cells comprising the recombinant RNA molecule and separating the one or more plant cells comprising the recombinant RNA molecule from the plant cells lacking the recombinant DNA molecule.

175. The method of any one of embodiments 158-174, wherein the plant propagule is a mosaic comprising both plant cells comprising the recombinant RNA molecule and plant cells lacking the recombinant RNA molecule.

176. The method of any one of embodiments 158-175, wherein the plant propagule is a mosaic comprising both plant cells comprising the endornaviral RDRP and plant cells lacking the endornaviral RDRP.

177. The method of any one of embodiments 158-176, wherein the plant propagule lacks DNA that encodes the recombinant RNA molecule.

178. The method of any one of embodiments 164-177, wherein the plant or plant part lacks DNA that encodes the recombinant RNA molecule.

179. The method of any one of embodiments 158-178, wherein the plant propagule comprises the cell, or a seed, seedling, ovule, embryo, pollen, root, stem, leaf, shoot, tuber, rhizome, stolon, bulb, explant, or callus comprising the cell.

180. The method of embodiment 179, further comprising multiplying the cell, seed, seedling, ovule, embryo, pollen, root, stem, leaf, shoot, tuber, rhizome, stolon, bulb, explant, or callus to obtain progeny, wherein the progeny comprise the recombinant RNA molecule.

181. The method of embodiment 180, wherein the multiplying of the cells consists of culturing a plurality of explants obtained from the cell, seed, seedling, ovule, embryo, pollen, root, stem, leaf, shoot, tuber, rhizome, stolon, bulb, explant, or callus.

182. The method of any one of embodiments 158-181, wherein the isolated propagule comprises the cell and the method further comprises regenerating a plant, seedling, ovule, embryo, pollen, root, stem, leaf, shoot, tuber, rhizome, stolon, bulb, explant, or callus comprising the recombinant RNA from the cell.

183. The method of any one of embodiments 158-182, wherein the isolated propagule comprises callus and the method further comprises regenerating a plant, seedling, ovule, embryo, pollen, root, stem, leaf, shoot, tuber, rhizome, stolon, bulb, or explant comprising the recombinant RNA from said callus.

184. The method of any one of embodiments 158-183, wherein a plant is regenerated and wherein the method further comprises recovering $F_1$ seed or $F_1$ progeny or clonal progeny comprising the recombinant RNA from the plant.

185. A method of providing a synthetic endornaviral satellite RNA to a plant comprising: grafting a scion onto a rootstock comprising a recombinant RNA molecule comprising, in 5' to 3' order, a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP, and wherein at least one cell of the rootstock and/or the scion comprises the endornaviral RDRP.

186. The method of embodiment 185, wherein DNA that encodes the recombinant RNA molecule is absent in the rootstock.

187. The method of embodiment 185 or 186, wherein the scion lacks the recombinant RNA molecule prior to grafting.

188. The method of any one of embodiments 185-187, wherein the rootstock comprises the endornaviral RDRP.

189. The method of any one of embodiments 185-188, wherein the endornaviral RDRP is provided by an endornavirus endemic to the rootstock, optionally wherein the endornavirus endemic to the rootstock is non-pathogenic and/or commensal.

190. The method of any one of embodiments 185-189, wherein the endornaviral RDRP is exogenously provided to the rootstock.

191. The method of any one of embodiments 185-190, wherein the scion comprises the endornaviral RDRP.

192. The method of any one of embodiments 185-191, wherein the RDRP is provided by an endornavirus endemic to the scion and/or wherein the RDRP is exogenously provided to the scion, optionally wherein the endornavirus endemic to the scion is non-pathogenic and/or commensal.

193. A method of producing a grafted plant comprising a recombinant RNA molecule comprising, in 5' to 3' order, a 5' replicase recognition sequence that is capable of being recognized by an endornaviral RNA-dependent RNA polymerase (RDRP); a cargo RNA sequence; and a 3' replicase recognition sequence that is capable of being recognized by the endornaviral RDRP, wherein the recombinant RNA molecule is provided by contacting the scion, the rootstock, or both the scion and the rootstock with a composition comprising the recombinant RNA molecule prior to grafting the scion onto the rootstock to produce the grafted plant.

194. The method of embodiment 193, wherein composition is a liquid, a gel, or a powder.

195. The method of embodiment 193 or 194, wherein the contacting comprises dipping the scion, the rootstock, or both the scion and the rootstock into the composition prior to grafting.

196. The method of any one of embodiments 193-195, wherein the endornaviral RDRP is provided by an endornavirus that is endemic to the scion, to the rootstock, or to both the scion and the rootstock.

197. The method of any one of embodiments 193-196, wherein the endornaviral RDRP is exogenously provided to the grafted plant.

198. The method of any one of embodiments 193-197, wherein the scion, the rootstock, and the grafted plant lack DNA encoding the recombinant RNA molecule.

199. A method for producing a plant that transmits a recombinant RNA molecule to progeny plants or seed comprising isolating an $F_1$ progeny plant or seed comprising at least one cell comprising an endornaviral RNA-dependent RNA polymerase (RDRP) and the recombinant RNA molecule comprising, in 5' to 3' order, a 5' replicase recognition sequence that is capable of being recognized by the endornaviral RDRP); a cargo RNA sequence; and a 3' replicase recognition sequence that is capable of being recognized by the endornaviral RDRP from a population of $F_1$ plants or seed obtained from at least one parent plant comprising the recombinant RNA molecule.

200. The method of embodiment 199, wherein the $F_1$ progeny plant or seed comprising the cell is isolated by screening the population of $F_1$ plants or seed obtained from a parent plant for the presence of the recombinant RNA molecule and propagating the $F_1$ progeny plant or seed comprising the recombinant RNA molecule.

201. The method of embodiment 199 or 200, wherein the cargo RNA sequence comprises RNA that encodes a selectable or scorable marker.

202. The method of embodiment 201, wherein the selectable or scorable marker is an RNA aptamer or a regulatory RNA.

203. The method of embodiment 202, wherein the regulatory RNA is selected from the group consisting of an siRNA or siRNA precursor, a miRNA or a miRNA precursor, a trans-acting siRNA or trans-acting siRNA precursor, an siRNA or miRNA decoy, an siRNA or miRNA cleavage blocker, an siRNA or miRNA recognition and cleavage sequence, a riboswitch, and a ribozyme.

204. The method of embodiment 201, wherein the selectable marker or scorable marker is an RNA sequence encoding a polypeptide.

205. The method of embodiment 204, wherein the polypeptide confers resistance in a plant cell to an antibiotic or to an herbicide.

206. The method of any one of embodiments 199-205, wherein the cargo RNA sequence comprises RNA that encodes a selectable marker and the $F_1$ progeny plant or seed comprising the recombinant RNA molecule is isolated by selecting the $F_1$ progeny plant or seed comprising the recombinant RNA molecule for presence of the selectable marker.

207. The method of any one of embodiments 199-206, wherein the $F_1$ progeny plant or seed lack DNA that encodes the recombinant RNA molecule.

208. The method of any one of embodiments 199-207, wherein the parent plant lacks DNA that encodes the recombinant RNA molecule.

209. The method of any one of embodiments 199-208, wherein the selected $F_1$ progeny plant transmits the recombinant RNA molecule to at least $F_2$ progeny.

210. The method of any one of embodiments 199-209, wherein the $F_1$ progeny plant or seed population is obtained from a parent plant used as a pollen recipient.

211. The method of any one of embodiments 199-210, wherein the $F_1$ progeny plant or seed population is obtained from a parent plant used as a pollen donor.

212. The method of any one of embodiments 199-211, wherein the $F_1$ progeny plant or seed population is obtained by selfing the parent plant.

213. The method of any one of embodiments 199-211, wherein the $F_1$ plant or seed population is obtained from the sexual crossing of two parent plants.

214. The method of any one of embodiments 199-213, wherein the parent plant that comprises the recombinant RNA molecule is the female parent plant.

215. The method of any one of embodiments 199-214, wherein the parent plant that comprises the recombinant RNA molecule is the male parent plant, and wherein the recombinant RNA molecule is transmitted in pollen of the male parent plant.

216. The method of any one of embodiments 199-215, wherein the parent plant or a part thereof comprising the plant cell is screened or selected for presence of the recombinant RNA molecule prior to isolating the $F_1$ progeny plant or seed, optionally wherein the part comprises floral tissue or male or female reproductive tissue.

217. The method of any one of embodiments 199-216, wherein the parent plant or one or more parts thereof are screened for systemic presence of the recombinant RNA molecule prior to isolating the $F_1$ progeny plants.

218. The method of any one of embodiments 199-217, wherein the pericarp of the parent plant is screened or selected for presence of the recombinant RNA molecule.

219. The method of any one of embodiments 199-218, wherein $F_1$ seeds are obtained from a parent plant selected for presence of the recombinant RNA molecule in pericarp tissue.

220. The method of any one of embodiments 199-219, wherein an $F_1$ seed of the parent plant is non-destructively screened for presence of the recombinant RNA molecule.

221. The method of any one of embodiments 199-220, wherein the $F_1$ seed of the parent plant is non-destructively screened by assaying maternally derived or endosperm tissue of the seed for the presence of the recombinant RNA molecule.

222. The method of any one of embodiments 199-221, further comprising introducing the recombinant RNA molecule or a polynucleotide encoding the recombinant RNA molecule into a plant cell and obtaining the parent plant comprising the recombinant RNA molecule from the plant cell.

223. The method of any one of embodiments 158-222, wherein the recombinant RNA molecule further comprises at least one additional element selected from the group consisting of: (a) at least one RNA encoding a viral movement protein (MP); (b) at least one tRNA-like sequence; and (c) an origin-of-assembly sequence (OAS).

224. The method of any one of embodiments 158-223, wherein: (a) the 5' replicase recognition sequence comprises at least one secondary structure provided in Table 8, 9, or 10; and/or (b) the 3' replicase recognition sequence comprises at least one secondary structure provided in Table 11, 12, or 13.

225. The method of any one of embodiments 158-224, wherein: (a) the 5' replicase recognition sequence comprises an RNA sequence encoded by at least one of SEQ ID NOs: 1-19, 372-405, 465, or 483-485, or the RNA sequence of SEQ ID NO:580, or an RNA sequence having at least 80%, 85%, 90%, 95%, 97%, 98%, or 99% sequence identity thereto; (b) the 3' replicase recognition sequence comprises an RNA sequence encoded by at least one of SEQ ID NOs: 20-38, 406-454, 467, or 486-488, or the RNA sequence of SEQ ID NO: 581, or an RNA sequence having at least 80%, 85%, 90%, 95%, 97%, 98%, or 99% sequence identity thereto; and/or (c) the endornaviral RDRP comprises a polypeptide having at least 85%, 90%, 95%, 98%, or 99% sequence identity to any one of SEQ ID NO: 367, 355-366, 368-371, 456, or 534-577.

226. The method of any one of embodiments 158-225, wherein: (a) the 5' replicase recognition sequence is derived from an endornavirus; (b) the 3' replicase recognition sequence is derived from an endornavirus; and/or (c) the 5' replicase recognition sequence and/or the 3' replicase recognition sequence comprises a 5' replicase recognition sequence and/or a 3' replicase recognition sequence set forth in Table 1.

227. The method of embodiment 226, wherein the 5' replicase recognition sequence and the 3' replicase recognition sequence are derived from the same endornavirus, comprise the 5' replicase recognition sequence and the 3' replicase recognition sequence pair from the same endornavirus set forth in Table 15, or are obtained from endornaviral genomes having at least 85%, 90%, 95%, 98%, or 99% sequence identity to one another; and, optionally, wherein the endornaviral RNA-dependent RNA polymerase is derived from the same endornavirus or are optionally obtained from endornaviral genomes wherein the 5' RNA replicase recognition sequence, the 3' RNA replicase recognition sequence, and/or the RDRP have at least 85%, 90%, 95%, 98%, or 99% sequence identity to the corresponding 5'

RNA replicase recognition sequence, 3' RNA replicase recognition sequence, and/or RDRP.

228. The method of any one of embodiments 158-227, wherein the endornaviral RDRP, the 5' replicase recognition sequence, and/or the 3' replicase recognition sequence are derived from an endornavirus selected from the group consisting of Bell pepper Endornavirus (BPEV), *Phaseolus vulgaris* alphaendornavirus 1 (PvEV-1), *Phaseolus vulgaris* endornavirus 2 (PvEV-2), and *Helianthus annuus* alphaendornavirus isolate BJ.

229. The method of any one of embodiments 158-228, wherein the propagule, plant, plant part, scion, and/or rootstock comprises a heterologous viral coat protein which can encapsidate the recombinant RNA molecule and/or comprises the recombinant RNA molecule encapsidated by a heterologous viral coat protein.

230. A method of barcoding a plant, plant cell, progeny thereof, or part thereof comprising providing to the plant or plant cell the recombinant RNA molecule of any one of embodiments 30, or 51 to 57, wherein the cargo RNA of the recombinant RNA molecule comprises a barcode RNA molecule, and wherein the plant or plant cell comprises an endornaviral RNA-dependent RNA polymerase (RDRP).

231. The method of embodiment 230, wherein the barcode RNA molecule comprises a sequence that uniquely identifies the plant, plant cell, progeny thereof, or part thereof.

232. The method of embodiment 230 or 231, wherein the barcode RNA molecule comprises a sequence that is not present in the genome and/or transcriptome of a wild-type plant of the same species, a pathogen thereof, or a symbiont thereof.

233. The method of any one of embodiments 230-232, wherein the barcode RNA molecule comprises a random sequence.

234. The method of any one of embodiments 230-233, wherein the barcode RNA molecule comprises a forward primer binding site and a reverse primer binding site that is not present in the genome and/or transcriptome of a wild-type plant of the same species, a pathogen thereof, or a symbiont thereof.

235. The method of any one of embodiments 230-234, wherein the barcode RNA molecule is up to about 14 kb in length.

236. The method of any one of embodiments 230-235, wherein the barcode RNA molecule has a length of 10 to 5000 nucleotides, 20 to 1000 nucleotides, or 50 to 500 nucleotides, optionally wherein the barcode RNA molecule has a length of 10, 20, 30, 40, 50, 60, 70, 80, 90, 100, 110, 120, 130, 140, 150, 160, 170, 180, 190, 200, 250, 300, 350, 400, 450, 500, 550, 600, 650, 700, 750, 800, 850, 900, 950, 1000, 1500, 2000, 2500, 3000, 3500, 4000, 4500, or 5000 nucleotides.

237. The method of any one of embodiments 230-236, wherein the barcode RNA molecule comprises a non-protein coding sequence.

238. The method of any one of embodiments 230-237, wherein the plant transmits the recombinant RNA molecule to progeny.

239. The method of any one of embodiments 230-238, wherein the plant, plant cell, progeny thereof, or part thereof lacks DNA that encodes the recombinant RNA molecule.

240. The method of any one of embodiments 230-239, further comprising isolating an $F_1$ progeny plant or seed comprising at least one cell comprising the endornaviral RDRP and the recombinant RNA molecule.

241. The method of embodiment 240, wherein the $F_1$ progeny plant or seed is obtained from the plant used as a pollen recipient.

242. The method of embodiment 240, wherein the $F_1$ progeny plant or seed is obtained from the plant used as a pollen donor.

243. The method of any one of embodiments 230-242, wherein the $F_1$ progeny plant or seed is obtained by selfing the plant.

244. The method of any one of embodiments 230-243, further comprising propagating the plant or plant cell to obtain a plant part or a plant propagule comprising the barcode RNA molecule, optionally wherein said propagule comprises callus, tubers, and/or rootstock.

245. A method of identifying a barcoded plant, plant part, or plant cell, the method comprising screening for the presence of a barcode RNA molecule in the plant, plant part, or plant cell, wherein the plant, plant part, or plant cell comprises the recombinant RNA molecule of any one of embodiments 30 or 51-57, wherein the cargo RNA of the recombinant RNA molecule comprises the barcode RNA molecule.

246. The method of embodiment 245, wherein the barcode RNA molecule comprises a sequence that uniquely identifies the plant, plant part, or plant cell.

247. The method of embodiment 245 or 246, wherein the barcode RNA molecule comprises a sequence that is not present in the genome and/or transcriptome of a wild-type plant of the same species, a pathogen thereof, or a symbiont thereof.

248. The method of any one of embodiments 245-247, wherein the barcode RNA molecule comprises a random sequence.

249. The method of any one of embodiments 245-248, wherein the barcode RNA molecule comprises a forward primer binding site and a reverse primer binding site that is not present in the genome and/or transcriptome of a wild-type plant of the same species, a pathogen thereof, or a symbiont thereof.

250. The method of any one of embodiments 245-249, wherein the barcode RNA molecule is up to about 14 kb in length.

251. The method of any one of embodiments 245-250, wherein the barcode RNA molecule has a length of 10 to 5000 nucleotides, 20 to 1000 nucleotides, or 50 to 500 nucleotides, optionally wherein the barcode RNA molecule has a length of 10, 20, 30, 40, 50, 60, 70, 80, 90, 100, 110, 120, 130, 140, 150, 160, 170, 180, 190, 200, 250, 300, 350, 400, 450, 500, 550, 600, 650, 700, 750, 800, 850, 900, 950, 1000, 1500, 2000, 2500, 3000, 3500, 4000, 4500, or 5000 nucleotides.

252. The method of any one of embodiments 245-251, wherein the barcode RNA molecule comprises a non-protein coding sequence.

253. The method of any one of embodiments 245-252, wherein the method comprises obtaining a nucleic acid sample from the plant, plant part, or plant cell; and detecting the presence of the barcode RNA molecule in the sample.

254. The method of any one of embodiments 245-253, wherein the screening comprises amplification and/or sequencing of the barcode RNA molecule.

255. The method of any one of embodiments 245-254, wherein the screening comprises detecting the barcode RNA molecule with a hybridization probe that hybridizes to at least a portion of the barcode RNA molecule.

256. The method of embodiment 255, wherein the hybridization probe comprises a detectable label.

257. The method of any one of embodiments 245-256, wherein the plant part comprises a seed, seedling, ovule, embryo, pollen, root, stem, leaf, shoot, tuber, rhizome, stolon, bulb, explant, or callus.

258. The method of embodiment 257, wherein the seed is non-destructively screened for presence of the barcode RNA molecule.

259. The method of any one of embodiments 245-259, wherein the plant, plant part, or plant cell comprises an endornaviral RDRP.

260. A endornaviral satellite system that is self-replicating when introduced into a plant or plant cell, comprising: (a) a recombinant endornaviral satellite RNA that comprises, in 5' to 3' order: (i) a 5' replicase recognition sequence that is capable of being recognized by an endornaviral RNA-dependent RNA polymerase (RDRP); (ii) a cargo RNA sequence; and (iii) a 3' replicase recognition sequence that is capable of being recognized by the endornaviral RDRP; wherein the recombinant endornaviral satellite RNA optionally further includes at least one additional element selected from the group consisting of: (iv) at least one RNA encoding a viral movement protein (MP); (v) at least one tRNA-like sequence (TLS); and (vi) an encapsidation recognition sequence (ERS); and (b) an exogenous endornavirus that is not endemic or native to the plant or plant cell, that is capable of replication in the plant or plant cells, and that encodes the endornaviral RDRP that recognizes the 5' and 3' replicase recognition sequences of the recombinant endornaviral satellite RNA.

261. The self-replicating endornaviral satellite system of embodiment 260, wherein the exogenous endornavirus is endemic or native to a different species, variety, or germplasm.

262. A recombinant RNA molecule comprising, in 5' to 3' order: (a) a 5' replicase recognition sequence that is capable of being recognized by an endornaviral RNA dependent RNA polymerase (RDRP); (b) a cargo RNA sequence; and (c) a 3' replicase recognition sequence that is capable of being recognized by the endornaviral RDRP, wherein the cargo RNA sequence is heterologous to the 5' and/or 3' replicase recognition sequences.

263. The recombinant RNA molecule of embodiment 262, wherein: (a) the 5' replicase recognition sequence is derived from an endornavirus; and/or (b) the 3' replicase recognition sequence is derived from an endornavirus.

264. The recombinant RNA molecule of embodiment 262 or 263, wherein the 5' replicase recognition sequence and the 3' replicase recognition sequence are derived from the same endornavirus or are obtained from endornaviral genomes having at least 85%, 90%, 95%, 98%, or 99% sequence identity to one another.

265. The recombinant RNA molecule of any one of embodiments 262 to 264, wherein the 5' replicase recognition sequence, the 3' replicase recognition sequence, and the endornaviral RNA-dependent RNA polymerase are derived from the same endornavirus or are obtained from endornaviral genomes wherein the 5' RNA replicase recognition sequence, the 3' RNA replicase recognition sequence, and/or the RDRP sequence have at least 85%, 90%, 95%, 98%, or 99% sequence identity to the corresponding 5' RNA replicase recognition sequence, 3' RNA replicase recognition sequence, and/or RDRP sequence.

266. The recombinant RNA molecule of any one of embodiments 262 to 265, wherein: (i) the 5' replicase recognition sequence comprises an RNA having at least 85% sequence identity to the RNA encoded by SEQ ID NO: 14 and the 3' replicase recognition sequence comprises an RNA having at least 85% sequence identity to the RNA encoded by SEQ ID NO: 33; or (ii) the 5' replicase recognition sequence comprises an RNA having at least 85% sequence identity to SEQ ID NO: 580 and the 3' replicase recognition sequence comprises an RNA having at least 85% sequence identity to SEQ ID NO: 581.

267. The recombinant RNA molecule of embodiment 266, wherein the RDRP comprises a polypeptide having at least 85%, 90%, 95%, 98%, or 99% sequence identity to SEQ ID NO: 367.

268. The recombinant RNA molecule of any one of embodiments 262 to 267, wherein the cargo RNA sequence is up to about 14 kb in length and comprises: (a) at least one protein coding sequence, (b) at least one non-coding sequence, or (c) both at least one protein coding sequence and at least one non-coding sequence.

269. The recombinant RNA molecule of any one of embodiments 262 to 268, wherein the endornaviral RNA dependent RNA polymerase (RDRP) comprises a polypeptide having at least 85%, 90%, 95%, 98%, or 99% sequence identity to any one of SEQ ID NO: 367, 355-366, 368-370, or 371, 456, or 534-577.

270. An agricultural formulation comprising the recombinant RNA molecule of any one of embodiments 262-269.

271. A plant comprising the recombinant RNA molecule of any one of embodiments 262-269 and an endornaviral RDRP that recognizes the 5' replicase recognition sequence and the 3' replicase recognition sequence.

272. The plant of embodiment 271, wherein the plant is of the family Asteraceae, Cucurbitaceae, Fabaceae, Lauraceae, Poaceae, or Solanaceae.

273. The plant of embodiment 271 or 272, wherein the plant lacks DNA that encodes the recombinant RNA molecule.

274. A plant propagule comprising the recombinant RNA molecule of any one of embodiments 262-269 and an endornaviral RDRP that recognizes the 5' replicase recognition sequence and the 3' replicase recognition sequence.

275. The plant propagule of embodiment 274, wherein the plant propagule comprises a cell, or a seed, seedling, ovule, embryo, pollen, root, stem, leaf, shoot, tuber, rhizome, stolon, bulb, explant, or callus comprising the cell.

276. The plant propagule of embodiment 274 or 275, wherein the plant propagule lacks DNA that encodes the recombinant RNA molecule.

277. A method of producing a modified plant propagule that comprises at least one plant cell comprising the recombinant RNA molecule of any one of embodiments 262-269, comprising isolating a plant propagule comprising at least one plant cell comprising the recombinant RNA molecule and an endornaviral RNA-dependent RNA polymerase (RDRP) from a mixed population of plant cells comprising both plant cells comprising the recombinant RNA molecule and plant cells lacking the recombinant RNA molecule.

278. The method of embodiment 277, wherein the mixed population of plant cells is screened or selected for the presence of the plant cell comprising the recombinant RNA molecule prior to isolating the plant propagule.

279. The method of embodiment 277 or 278, wherein the isolating comprises selecting for the plant cell comprising the recombinant RNA molecule prior to isolating the plant propagule.

280. The method of any one of embodiments 277-278, wherein the mixed population is a population of protoplasts or a population of cells in callus, an explant, a plant part, or whole plant.

281. The method of embodiment 280, wherein the mixed population is screened or selected for the presence or the systemic presence of the recombinant RNA molecule prior to isolating the plant propagule.

282. A method of increasing a plant's resistance and/or tolerance to a pest or pathogen, comprising providing to a plant the recombinant RNA molecule of any one of embodiments 262-269, wherein the plant comprises an RDRP protein that recognizes the 5' replicase recognition sequence and 3' replicase recognition sequence, whereby the RDRP protein catalyzes synthesis of a synthetic endornaviral satellite RNA from the recombinant RNA molecule, and wherein the cargo RNA sequence effects an increase in the plant's resistance and/or tolerance to a pest or pathogen, relative to that in a plant not provided with the recombinant RNA molecule.

283. The method of embodiment 282, wherein the pest or pathogen is a bacterium, a fungus, an oomycete, or an invertebrate, optionally wherein the fungus is a *Botrytis* sp.

284. A method for producing an F1 plant that transmits the recombinant RNA molecule of any one of embodiments 262-269 to progeny plants or seed, comprising isolating an F1 progeny plant or seed comprising at least one plant cell comprising the recombinant RNA molecule and an endornaviral RNA-dependent RNA polymerase (RDRP) that recognizes the 5' replicase recognition sequence and the 3' replicase recognition sequence of the recombinant RNA molecule from a population of F1 plants or seed obtained from at least one parent plant comprising the recombinant RNA molecule and the RDRP.

285. The method of embodiment 284, wherein the parent plant or one or more parts thereof are screened or selected for presence of the recombinant RNA molecule, prior to isolating the F1 progeny plants.

286. The method of embodiment 284 or 285, wherein the one or more part comprise floral tissue or male or female reproductive tissue.

287. The method of any one of embodiments 284-286, wherein the F1 progeny plant or seed lack DNA that encodes the recombinant RNA molecule.

288. The method of any one of embodiments 284-287, wherein the RDRP is provided to the F1 progeny plant or seed by a commensal non-pathogenic endornavirus endemic in the at least one parent plant.

289. The method of any one of embodiments 284-288, wherein the F1 progeny plant or seed population is obtained by selfing the parent plant.

290. The method of any one of embodiments 284-288, wherein the F1 plant or seed population is obtained from the sexual crossing of two parent plants.

EXAMPLES

The following examples illustrate non-limiting embodiments of compositions and techniques for providing recombinant DNA molecules and the recombinant RNA molecules encoded therein, as described in detail in this specification.

The recombinant RNA molecules are useful for generating synthetic endornaviral satellite RNAs ("endornaviral satellites") based on sequences from endornaviruses such as those found natively or endemically in a plant, or exogenously introduced into a plant, e.g., as a persistent and/or commensal endornaviral population and can be non-pathogenic to the plant. These synthetic endornaviral satellite RNAs are designed to carry at least one coding or non-coding cargo RNA sequence, and serve, e.g., as persistent RNA vectors in a plant or plant cell, which in certain embodiments are transmitted to succeeding generations or progeny plants. Synthetic endornaviral satellites thus provide a means for providing to plants (including successive generations of plants) heritable expression of a desired cargo (e.g., a non-coding RNA, a messenger RNA, an RNA barcode) without the use of heritable DNA, such as a transgene or other heritable DNA vector or construct. The synthetic endornaviral satellite RNA can further be complexed with other biological materials such as polypeptides, sugars or carbohydrates, lipids, or additional polynucleotides. In embodiments, the synthetic endornaviral satellite RNA is encapsidated with a suitable viral coat protein to form synthetic endornaviral satellite virus particle; these encapsidated satellite RNAs can be delivered to plants, e.g., to cause a phenotype effected by the cargo RNA(s).

The synthetic endornaviral satellite RNA or synthetic endornaviral satellite particles typically exploit the replication machinery of a target plant's endogenous endornaviral virome (alternatively, the replication machinery, e.g., the appropriate RDRP, is added exogenously, for example, by co-transformation with a construct encoding the RDRP or by introduction of an exogenous endornavirus), and thus the synthetic endornaviral satellite is able to maintain itself after initial delivery. This is achieved via inclusion in the endornaviral satellite sequence of replicase recognition sequences that enable the synthetic endornaviral satellite RNA's replication in the target plant by the plant's endogenous endornaviral virome or by an exogenously provided endornaviral RDRP. A list of replicase recognition sequences for a non-exhaustive range of endornaviruses and their host plants is provided in Table 1. In embodiments, the synthetic endornaviral satellite RNA is complexed with or encapsidated in a polypeptide (e.g., a viral coat protein) to increase stability, for example, by incorporation of an appropriate viral encapsidation signal in the synthetic endornaviral satellite RNA and contact with the appropriate viral coat protein. A list of encapsidation sequences and associated coat proteins are listed in Table 2. Alternatively, the synthetic endornaviral satellite RNA is complexed with or encapsulated in a lipid-based composition such as unilamellar or multilamellar vesicles or liposomes or lipid nano- or microparticles. The synthetic endornaviral satellite RNA can be designed to move systemically to parts of the plant that are distal to the point of delivery, for example, by incorporation of a viral movement protein and/or a tRNA-like sequences in the synthetic endornaviral satellite RNA. A list of viral movement proteins and tRNA-like sequences are provided in Tables 3 and 4 respectively.

It is understood that various other embodiments can be practiced, given the general description provided herein.

CONTENTS OF EXAMPLES

| Example | Title |
|---|---|
| Example 1 | Endornaviral satellite for sustained gene expression in Pepper via agroinfiltration delivery |
| Example 2 | Endornaviral satellite for sustained multi-gene expression in Pepper via agroinfiltration delivery |
| Example 3 | Endornaviral satellite for sustained non-coding RNA delivery in Pepper via agroinfiltration delivery |
| Example 4 | Endornaviral satellite for sustained gene expression in Pepper via biolistic delivery |
| Example 5 | Endornaviral satellite for sustained gene expression and movement protein aided movement in Pepper via biolistic delivery |

-continued

| Example | Title |
|---|---|
| Example 6 | Endornaviral satellite for sustained gene expression and tRNA aided movement in Pepper via biolistic delivery. |
| Example 7 | Endornaviral satellite for sustained gene expression and tRNA aided movement in Rice via biolistic delivery. |
| Example 8 | Endornaviral satellite with flanking ribozymes for sustained gene expression in Pepper via biolistic delivery. |
| Example 9 | Encapsidated endornaviral satellite RNA for sustained gene expression and movement in Pepper via high pressure spray-based delivery |
| Example 10 | Encapsidated endornaviral satellite RNA containing introns for sustained gene expression and movement in Pepper via high pressure spray-based delivery |
| Example 11 | In vitro production of encapsidated endornaviral satellite RNA for sustained gene expression and movement in Pepper via biolistic delivery |
| Example 12 | Encapsidated endornaviral satellite RNA production in a fungal chassis |
| Example 13 | Encapsidated endornaviral satellite RNA production in a bacterial chassis |
| Example 14 | Encapsidated endornaviral satellite RNA production in an insect cell chassis |
| Example 15 | Vertical transmission of an anti-botrytis cargo RNA in pepper plants |
| Example 16 | Identification of rice endornaviral sequences |
| Example 17 | Identification of tomato endornaviral sequences |
| Example 18 | In vitro and in planta stability of encapsidated synthetic endornaviral satellite RNAs |
| Example 19 | Synthetic endornaviral satellite RNAs with antifungal, insecticidal, and/or herbicide resistance cargo RNAs |
| Example 20 | Synthetic endornaviral satellite RNAs encoding an herbicide resistance protein useful as a selectable marker |
| Example 21 | Synthetic endornaviral satellite RNAs including a modified 5' replicase recognition sequence |
| Example 22 | Anti-fungal activity of synthetic endornaviral satellite RNA cargo dsRNA sequences |
| Example 23 | Synthetic endornaviral satellite RNAs for enhanced cargo translation |

Example 1. Endornaviral Satellite for Sustained Gene Expression in Pepper Via Agroinfiltration Delivery This example describes how to build an endornaviral satellite to sustain expression of a cargo gene in pepper plants.

A T-DNA vector is built with a strong constitutive promoter-terminator pair, such as p35S and tNos, driving the expression of, from 5' to 3', the 5' replicase recognition sequence from Bell pepper Endornavirus (BPEV), firefly luciferase (the cargo sequence), and the 3' replicase recognition sequence from BPEV (Table 7, construct 1).

This T-DNA vector is then transformed into a GV3101 strain of *Agrobacterium tumefaciens* and infiltrated into a Pepper plant with an endogenous BPEV infection. See, e.g., Park et al. (2021) Int. J. Mol. Sci., 22:3921; doi: 10.3390/ijms22083921. Three weeks after inoculation, the persistence of the delivered vector is verified via a qPCR assay, performed on RNA extracted from the tissue the RNA was delivered to, targeted to quantify the delivered cargo sequence RNA. A luciferase assay is also used to quantify protein level over background.

Example 2. Endornaviral Satellite for Sustained Multi-Gene Expression in Pepper Via Agroinfiltration Delivery This example describes how to build an endornaviral satellite to sustain expression of multiple cargo genes in pepper plants. In embodiments, endornaviral satellite constructs for delivering multiple protein-encoding cargo sequences, include an additional internal ribosome entry site (IRES) 5' and adjacent to the start codon of the second (and any additional) protein-encoding cargo sequences.

A T-DNA vector is built with a strong constitutive promoter-terminator pair, such as p35S and tNos, driving the expression of, from 5' to 3', the 5' replicase recognition sequence from Bell pepper Endornavirus (BPEV), firefly luciferase gene (first cargo sequence), an internal ribosome entry site (Table 5), the green fluorescent protein (GFP) reporter gene (second cargo sequence), and the 3' replicase recognition sequence from BPEV (Table 7, construct 2).

This T-DNA vector is then transformed into a GV3101 strain of *Agrobacterium tumefaciens* and infiltrated into a Pepper plant with an endogenous BPEV infection. Three weeks after inoculation, the persistence of the delivered vector can be verified via a qPCR assay, performed on RNA extracted from the tissue the RNA was delivered to, targeted to quantify the delivered cargo sequence RNAs. A luciferase assay is also used to quantify protein level over background. A Leica fluorescence microscope is used to quantify the GFP signal over background in the delivered tissue.

Example 3. Endornaviral Satellite for Sustained Non-Coding RNA Delivery in Pepper Via Agroinfiltration Delivery This example describes how to build an endornaviral satellite to sustain delivery of a non-coding RNA in pepper plants.

A T-DNA vector is built with a strong constitutive promoter-terminator pair, such as p35S and tNos, driving the expression of, from 5' to 3', the 5' replicase recognition sequence from Bell pepper Endornavirus (BPEV), a trans-cleaving hammerhead ribozyme, and the 3' replicase recognition sequence from BPEV (Table 7, construct 3). The trans-cleaving hammerhead ribozyme is designed to anneal to and cleave the mRNA of the endogenous pepper gene (phytoene desaturase, PDS), using the Ribosoft algorithm (Khan A A, Fox E K, Górzny MŁ, et al (2013) pH Control of the Electrostatic Binding of Gold and Iron Oxide Nanoparticles to Tobacco Mosaic Virus. Langmuir 29:2094-2098).

This T-DNA vector is then transformed into a GV3101 strain of *Agrobacterium tumefaciens* and infiltrated into a Pepper plant with an endogenous BPEV infection. Three weeks after inoculation, the persistence of the delivered vector is verified via a qPCR assay, performed on RNA extracted from the tissue the RNA was delivered to, targeted to quantify the delivered cargo sequence RNA. Another qPCR assay for the PDS gene targeted by the trans-cleaving ribozyme quantifies the degree of PDS transcript reduction resulting from cleavage of the PDS mRNA, as compared to a control treatment.

Example 4. Endornaviral Satellite for Sustained Gene Expression in Pepper Via Biolistic Delivery This example describes biolistic delivery of an endornaviral satellite and sustained expression of a cargo gene in pepper plants.

A vector was built using the pACYC backbone with a T7 promoter driving the expression of, from 5' to 3', the 5' replicase recognition sequence from Bell pepper Endornavirus (BPEV), firefly luciferase (cargo sequence), and the 3' replicase recognition sequence from BPEV (Table 7, construct 4). The plasmid was used as a template for a PCR reaction to amplify the expression cassette with a T7 promoter. This amplicon was used as the template for an in vitro transcription reaction using a T7 flash Ampliscribe kit from Lucigen.

The in vitro transcribed RNA was then loaded onto 0.6 micromolar gold nanoparticles from Bio-Rad following the guidelines specified in the Helios gene gun manual. The RNA-coated gold nanoparticles were fired into expanded leaf tissue of a pepper plant with a Bio-Rad Helios gene gun set at 100 psi pressure. Three weeks after inoculation, the persistence of the delivered vector was verified via a qPCR assay, performed on RNA extracted from the bombarded tissue. Gel analysis of RT-PCR reactions performed on negative-strand-specific cDNA was also performed; bands of the correct size were observed in samples from the bombarded replicate samples but not in samples from the non-bombarded controls, evidence of replication of the endornaviral satellite in the bombarded tissue. A luciferase assay was also used to quantify cargo protein level over background.

Example 5. Endornaviral Satellite for Sustained Gene Expression and Movement Protein-Aided Movement in Pepper Via Biolistic Delivery This example describes biolistic delivery of an endornaviral satellite for persistent expression and systemic spread of a cargo sequence in pepper plants.

A vector was built using the pACYC backbone with a T7 promoter driving the expression of, from 5' to 3', the 5' replicase recognition sequence from Bell pepper Endornavirus (BPEV), firefly luciferase, an internal ribosome entry site (Table 5), a viral movement protein (Table 3), and the 3' replicase recognition sequence from BPEV (Table 7, construct 5). The plasmid was used as a template for a PCR reaction to amplify the expression cassette with a T7 promoter. This amplicon was used as the template for an in vitro transcription reaction using a T7 flash Ampliscribe kit from Lucigen.

The in vitro transcribed RNA was then loaded onto 0.6 micromolar gold nanoparticles from BioRad following the guidelines specified in the Helios gene gun manual. The RNA-coated gold nanoparticles were fired into expanded leaf tissue of a pepper plant with a Bio-Rad Helios gene gun set at a 100 psi pressure. At various timepoints after inoculation, presence or absence of the cargo sequence RNA was detected via a qPCR assay, performed on RNA samples extracted from the bombarded leaves, from (non-bombarded) leaves distal to the bombarded leaves (to detect movement and/or systemic expression of the cargo sequence), and from fruit.

Example 6. Endornaviral Satellite for Sustained Gene Expression and tRNA-Aided Movement in Pepper Via Biolistic Delivery This example describes biolistic delivery of an endornaviral satellite for persistent expression and systemic spread of a cargo sequence in pepper plants.

A vector was built with a T7 promoter driving the expression of, from 5' to 3', the 5' replicase recognition sequence from Bell pepper Endornavirus (BPEV), firefly luciferase, a tRNA-like sequence (Table 4), and the 3' replicase recognition sequence from BPEV (Table 7, construct 6). The plasmid was used as a template for a PCR reaction to amplify the expression cassette with a T7 promoter. This amplicon was used as the template for an invitro transcription reaction using a T7 flash Ampliscribe kit from Lucigen.

The in vitro transcribed RNA was loaded onto 0.6 micromolar gold nanoparticles from BioRad, following the guidelines specified in the Helios gene gun manual. The RNA-coated gold nanoparticles were fired into expanded leaf tissue of a pepper plant with a Bio-Rad Helios gene gun set at a 100 psi pressure. The pepper plant had previously been confirmed to have an endogenous BPEV infection via RT-PCR. At various timepoints after inoculation, presence or absence of the cargo sequence RNA was detected via a qPCR assay, performed on RNA samples extracted from the bombarded leaves, from (non-bombarded) leaves distal to the bombarded leaves (to detect movement and/or systemic expression of the cargo sequence), and from fruit. At 16 days after inoculation, a faint positive signal (bands corresponding to the expected molecular weight of the amplified cargo sequence product) was observed in samples from the distal leaves. At 36 days after inoculation, strongly positive bands were observed in samples from the distal leaves. At 72 days after inoculation, strongly positive bands were observed in samples from the distal leaves and faintly positive bands were observed in samples from the fruit.

Example 7. Endornaviral Satellite for Sustained Gene Expression and tRNA-Aided Movement in Rice Via Biolistic Delivery This example describes biolistic delivery of an endornaviral satellite for persistent expression and systemic spread of a cargo sequence in rice plants.

A vector is built with a T7 promoter driving the expression of, from 5' to 3', the 5' replicase recognition sequence from *Oryza sativa* Endornavirus (OsEV), firefly luciferase, a tRNA-like sequence (Table 4), and the 3' replicase recognition sequence from OsEV (Table 7, construct 7). The plasmid is used as a template for a PCR reaction to amplify the expression cassette with a T7 promoter. This amplicon is used as the template for an invitro transcription reaction using a T7 flash Ampliscribe kit from Lucigen.

The in vitro transcribed RNA is then loaded onto 0.6 micromolar gold nanoparticles from BioRad, following the guidelines specified in the Helios gene gun manual. The RNA-coated gold nanoparticles are fired into expanded leaf tissue of a rice plant with a Bio-Rad Helios gene gun set at a 100 psi pressure. The rice plant is previously confirmed to have an endogenous OsEV infection via RT-PCR. At various timepoints after inoculation, presence or absence of the cargo sequence RNA is verified via a qPCR assay, performed on RNA samples extracted from the bombarded leaves, from (non-bombarded) leaves distal to the bombarded leaves (to detect movement and/or systemic expression of the cargo sequence), and optionally from the grain (seed).

Example 8. Endornaviral Satellite with Flanking Ribozymes for Sustained Gene Expression in Pepper Via Biolistic Delivery This example describes biolistic delivery of an endornaviral satellite for persistent expression and systemic spread of a cargo sequence in pepper plants.

A vector is built with a T7 promoter driving the expression of, from 5' to 3', a hammerhead ribozyme, the 5' replicase recognition sequence from Bell pepper Endornavirus (BPEV), firefly luciferase, and the 3' replicase recognition sequence from BPEV, and a HDV ribozyme (Table 7, construct 8). The plasmid is used as a template for a PCR reaction to amplify the expression cassette with a T7 promoter. This amplicon is used as the template for an invitro transcription reaction using a T7 flash Ampliscribe kit from Lucigen.

The in vitro transcribed RNA is then loaded onto 0.6 micromolar gold nanoparticles from BioRad, following the guidelines specified in the Helios gene gun manual. The RNA-coated gold nanoparticles are fired into expanded leaf tissue of a pepper plant with a Bio-Rad Helios gene gun set at a 100 psi pressure. At various timepoints after inoculation, presence or absence of the cargo sequence RNA is verified via a qPCR assay, performed on RNA samples extracted from the bombarded leaves. A luciferase assay is also used to quantify protein level over background.

Example 9. Encapsidated Endornaviral Satellite for Sustained Gene Expression and Movement in Pepper Via High Pressure Spray-Based Delivery This example describes spray delivery of an encapsidated endornaviral satellite for persistent expression and systemic spread of a cargo sequence in pepper plants. A T-DNA vector is designed to include two different expression cassettes. The first one includes a strong constitutive promoter-terminator pair, such as p35S and t35S, driving the expression of a tobamoviral coat protein (Table 2).

The second expression cassette has a medium strength promoter-terminator pair, such as pAtUBQ1 and tHSP, driving the expression of a construct consisting of, from 5' to 3', a hammerhead ribozyme, the 5' replicase recognition sequence from Bell pepper Endornavirus (BPEV), the firefly luciferase coding sequence, an internal ribosome entry site (Table 5), a viral movement protein (Table 3), a tRNA-like sequence (Table 4), an OAS sequence for the tobamoviral coat protein in the other expression cassette (Table 2), the 3' replicase recognition sequence from BPEV, and a HDV ribozyme (Table 7, construct 9).

This T-DNA vector is then transformed into a GV3101 strain of *Agrobacterium tumefaciens* and infiltrated into leaves of a *Nicotiana benthamiana* plant. After three days the infiltrated tissue is homogenized, and encapsidated satellite RNA is isolated via a standard PEG precipitation protocol (Mueller, A., Kadri, A., Jeske, H., and Wege, C. (2010). In vitro assembly of Tobacco mosaic virus coat protein variants derived from fission yeast expression clones or plants. J Virol Methods 166, 77-85.). These isolated virions, or the crude lysate, is then delivered to the pepper plants via spraying at ~8 bar pressure with a modified air brush onto leaf surfaces of 2-3 week old pepper plants according to a published protocol (Dalakouras, A., Wassenegger, M., McMillan, J. N., Cardoza, V., Maegele, I., Dadami, E., et al. (2016). Induction of Silencing in Plants by High-Pressure Spraying of In vitro-Synthesized Small RNAs. Front Plant Sci 07, 1327).

At various timepoints after inoculation, presence or absence of the cargo sequence RNA is verified via a qPCR assay, performed on RNA samples extracted from the spray-inoculated leaves, or from post-inoculation-grown distal tissue (e.g., new leaf growth). A luciferase assay is also used to quantify protein level over background. Presence of the cargo sequence RNA in non-sprayed (distal) tissue indicated systemic expression and/or movement of the cargo sequence RNA.

Example 10. Encapsidated Endornaviral Satellite Containing Introns for Sustained Gene Expression and Movement in Pepper Via High Pressure Spray-Based Delivery This example describes spray delivery of an endornaviral satellite containing introns for persistent expression and systemic spread of a cargo sequence in pepper plants.

A T-DNA vector is designed to include two different expression cassettes. The first one includes a strong constitutive promoter-terminator pair, such as p35S and tNos, driving the expression of a tobamoviral coat protein (Table 2). The second expression cassette has a medium strength promoter-terminator pair, such as pAtUBQ1 and tHSP, driving the expression of a construct consisting of, from 5' to 3', a hammerhead ribozyme, the 5' replicase recognition sequence from Bell pepper Endornavirus (BPEV), the firefly luciferase coding sequence, an internal ribosome entry site (Table 5), a viral movement protein (Table 3), a tRNA-like sequence (Table 4), an OAS sequence for the tobamoviral coat protein in the other expression cassette (Table 2), the 3' replicase recognition sequence from BPEV, and a HDV ribozyme (Table 7, construct 10). An intron from a plant (for example, see, Table 6) is inserted into the satellite coding sequence such that it is predicted to be correctly spliced out with a high efficiency by a splicing prediction algorithm.

This T-DNA vector is transformed into a GV3101 strain of *Agrobacterium tumefaciens* and infiltrated into leaves of a *Nicotiana benthamiana* plant. After three days the infiltrated tissue is homogenized, and encapsidated satellite RNA is isolated via a standard PEG precipitation protocol (Mueller, A., Kadri, A., Jeske, H., and Wege, C. (2010). In vitro assembly of Tobacco mosaic virus coat protein variants derived from fission yeast expression clones or plants. J Virol Methods 166, 77-85.).

These isolated virions, or the crude lysate, are delivered to the pepper plants via spraying at ~8 bar pressure with a modified air brush onto leaf surfaces of 2-3 week old pepper plants according to a published protocol (Dalakouras, A., Wassenegger, M., McMillan, J. N., Cardoza, V., Maegele, I., Dadami, E., et al. (2016). Induction of Silencing in Plants by High-Pressure Spraying of In vitro-Synthesized Small RNAs. Front Plant Sci 07, 1327).

At various timepoints after inoculation, presence or absence of the cargo sequence RNA is verified via a qPCR assay, performed on RNA samples extracted from spray-inoculated leaves, or from post-inoculation-grown distal tissue (e.g., new leaf growth). A luciferase assay is also used to quantify protein level over background. Presence of the cargo sequence RNA in non-sprayed (distal) tissue indicated systemic expression and/or movement of the cargo sequence RNA.

Example 11. In Vitro Production of Encapsidated Endornaviral Satellite for Sustained Gene Expression and Movement in Pepper Via Biolistic Delivery This example describes biolistic delivery of an in vitro synthesized, encapsidated endornaviral satellite for persistent expression and systemic spread of a cargo sequence in pepper plants.

A construct is built via Golden Gate assembly of gene fragments synthesized by TWIST biosciences that include, from 5' to 3', a T7 promoter, the 5' replicase recognition sequence from Bell pepper Endornavirus (BPEV), the firefly luciferase coding sequence, an internal ribosome entry site (Table 5), a viral movement protein (Table 3), a tRNA-like sequence (Table 4), an OAS sequence (Table 2), the 3' replicase recognition sequence from BPEV (Table 7, construct 11). This is used as the template for an in vitro transcription reaction using a T7 flash Ampliscribe kit from Lucigen.

In parallel, tobamoviral coat protein is purified from *Nicotiana benthamiana* plants infected with the tobamovirus through a published PEG precipitation protocol followed by a glacial acetic acid-mediated dissociation of the viral capsids to separate viral nucleic acids from the coat protein (Smith M L, Corbo T, Bernales J, et al (2007) Assembly of trans-encapsidated recombinant viral vectors engineered from Tobacco mosaic virus and Semliki Forest virus and their evaluation as immunogens. Virology 358:321-333). The purified coat protein is then dialyzed against 0.1 M phosphate pH 7.0 at 4° C., centrifuged at 20,000×g for 30 min to remove any precipitate that formed and pre-equilibrated for 36 to 48 h at room temperature, to permit 20 S disk formation. It is then co-incubated with the in vitro transcribed RNA at a 48:1 ratio and incubated overnight at room temperature to allow encapsidation of the RNA. The RNA encapsidation process is indicated by increasing absorbance at 310 nm, which can be monitored with a Thermo Fisher Scientific NanoDrop™ microvolume spectrophotometer.

The encapsidated satellite can then be either directly deposited onto tefzel tubing via a PEG precipitation (Smith M L, Corbo T, Bernales J, et al. (2007) Assembly of trans-encapsidated recombinant viral vectors engineered from Tobacco mosaic virus and Semliki Forest virus and their evaluation as immunogens. Virology 358:321-333), or be first associated with 6 nanomolar gold nanoparticles according to a published protocol (Khan A A, Fox E K, Górzny MŁ, et al. (2013) pH Control of the Electrostatic Binding of Gold and Iron Oxide Nanoparticles to Tobacco Mosaic Virus. Langmuir 29:2094-2098), followed by deposition onto tefzel tubing according to the published protocol for deposition in the Bio-Rad Helios gene gun manual. This tubing is then used to assemble cartridges for biolistic delivery of the encapsidated satellite RNA into expanded leaf tissue of a pepper plant with a Bio-Rad Helios gene gun set at to 100 psi pressure.

Example 12. Encapsidated Endornaviral Satellite Production in a Fungal Chassis

To generate endornaviral satellites in a *Schizosaccharomyces pombe* (fission yeast) production chassis, expression plasmids are designed based on the vector (pMB332) with an ad promoter and an actin terminator from *S. pombe* (Bröker, Michael, and Oskar Bäuml. "New expression vectors for the fission yeast *Schizosaccharomyces pombe*." FEBS letters 248.1-2 (1989): 105-110.)[9]. This plasmid encodes expression cassettes for the endornaviral satellite, described previously in Example 6, and the tobacco mosaic virus (TMV) coat protein. This plasmid is used to transform *S. pombe* according to published protocols and the resultant strains are grown to confluency and induced to produce the endornaviral satellite RNA and the TMV coat protein in the cell. The satellite RNA is encapsidated by the TMV coat protein intracellularly, resulting in encapsidated particles. These particles are then isolated via lysis of the cells according to a PEG precipitation protocol (Mueller, A., Kadri, A., Jeske, H., and Wege, C. (2010). In vitro assembly of Tobacco mosaic virus coat protein variants derived from fission yeast expression clones or plants. J Virol Methods 166, 77-85). The isolated encapsidated RNAs or the crude lysate are then delivered to plants via spraying at ~8 bar pressure using a modified air brush onto leaf surfaces of 2-3 week old pepper plants according to a published protocol (Dalakouras, A., Wassenegger, M., McMillan, J. N., Cardoza, V., Maegele, I., Dadami, E., et al. (2016). Induction of Silencing in Plants by High-Pressure Spraying of In vitro-Synthesized Small RNAs. Front Plant Sci 07, 1327).

Example 13. Encapsidated Endornaviral Satellite Production in a Bacterial Chassis To generate endornaviral satellites in an *Escherichia coli* production chassis, expression plasmids are designed based on a high copy pUC vector that has a T7 promoter and a T7 terminator. This plasmid encodes expression cassettes for the endornaviral satellite, described previously in example 6. This plasmid was used to transform *E. coli* according to published protocols and the resultant strains were grown to confluency then lysed. The satellite RNA was isolated via excision from a 3% Urea PAGE gel.

The crude lysate can also be used directly.

The satellite RNA was coated with the TMV coat protein, isolated from plants infected with TMV, as described in example 11. These encapsidated RNAs were then isolated by a published PEG precipitation protocol (Mueller, A., Kadri, A., Jeske, H., and Wege, C. (2010). In vitro assembly of Tobacco mosaic virus coat protein variants derived from fission yeast expression clones or plants. J Virol Methods 166, 77-85). The isolated encapsidated RNAs were then delivered to plants via spraying at ~8 bar pressure using a modified air brush onto leaf surfaces of 2-3-week-old pepper plants according to a published protocol (Dalakouras, A., Wassenegger, M., McMillan, J. N., Cardoza, V., Maegele, I., Dadami, E., et al. (2016). Induction of Silencing in Plants by High-Pressure Spraying of In vitro-Synthesized Small RNAs. Front Plant Sci 07, 1327).

Example 14. Encapsidated Endornaviral Satellite Production in an Insect Cell Chassis To generate endornaviral satellites in a Spodopterafrugiperda cell culture, a pFastBac donor plasmid that has a OpIE1 promoter and a IElterminator is designed. This plasmid encodes expression cassettes for the endornaviral satellite, described previously in Example 6. Spodopterafrugiperda SF9 or SF21 cells are co-transfected with CELLFECTIN reagent (ThermoFisher, USA) and this plasmid. The SF9 or SF21 cells are cultured in monolayer or in suspension before collecting RNA. The satellite RNA is then isolated via excision from a 3% Urea PAGE gel. The crude lysate can also be used directly.

The satellite RNA is then coated with the TMV coat protein, isolated from plants infected with TMV, as described in Example 11. These encapsidated RNAs are isolated according to a standard PEG precipitation protocol (Mueller, A., Kadri, A., Jeske, H., and Wege, C. (2010). In vitro assembly of Tobacco mosaic virus coat protein variants derived from fission yeast expression clones or plants. J Virol Methods 166, 77-85. (2010)). The isolated encapsidated RNAs are delivered to plants via spraying at ~8 bar pressure using a modified air brush onto leaf surfaces of 2-3-week-old pepper plants according to a published protocol (Dalakouras, A., Wassenegger, M., McMillan, J. N., Cardoza, V., Maegele, I., Dadami, E., et al. (2016). Induction of Silencing in Plants by High-Pressure Spraying of In vitro-Synthesized Small RNAs. Front Plant Sci 07, 1327).

Example 15. Vertical Transmission of an Anti-*Botrytis* Cargo RNA in Pepper Plants This example demonstrates how an endornaviral satellite can be used to generate fungal resistant germplasm without necessitating transgenesis.

In vitro transcribed RNA molecules encoding the following constructs (listed from 5' to 3') were ballistically delivered into leaves of twelve "Ace F1" hybrid pepper plants (FIG. 15): (Construct 1, carrying a cargo RNA encoding dsRNAs targeting the *Botrytis cinerea* genes DCL1 and DCL2) 5'UTR_226 bp-BcDCL1_dsRNA-BcDCL2_dsRNA-ZmHSP101_IRES-TMVMP-Ile-3'UTR_113 bp_w_PolyC_tail (SEQ ID NO: 578); (Construct 2, carrying a cargo RNA encoding a heterologous pathogenesis-related (PR) protein that enhances resistance to bacterial and fungal pathogen infection, *Panax ginseng* pathogenesis-related protein family 10 gene, "PgPR10") 5'UTR_226 bp-HCRSV_IRES-PgPR10_1-ZmHSP101_IRES-TMVMP-Ile-3'UTR_113 bp_w_PolyC_tail (SEQ ID NO: 579).

Systemic mobility and persistence of these molecules was further demonstrated across these plants using RT-PCR in systemic tissues (tissue samples taken from parts of the plant distal to the site of treatment). The plants were then grown to maturity and their fruits were harvested. The pericarp of the pepper fruits was screened using RT-PCR for the presence of delivered RNA and 32% of all the assayed fruit were positive.

Seeds were collected from RT-PCR positive mature fruit of these plants, vernalized, and then planted in soil. Cotyledons from these second-generation seedlings were then collected and RNA was extracted from individual seedlings. A pooled screening strategy was used where RNA from 8 seedlings were combined, and RT-PCR was used to look for presence of the delivered RNA molecules in these tissues. A positive signal was observed in four of the 12 pooled groups. Each of the 8 individuals in two of these four positive pooled groups was analyzed by RT-PCR and one positive individual per pool was identified. Thus, these results indicate a vertical transmission rate of at least 1/24 (i.e., about 4%).

Figure 15:
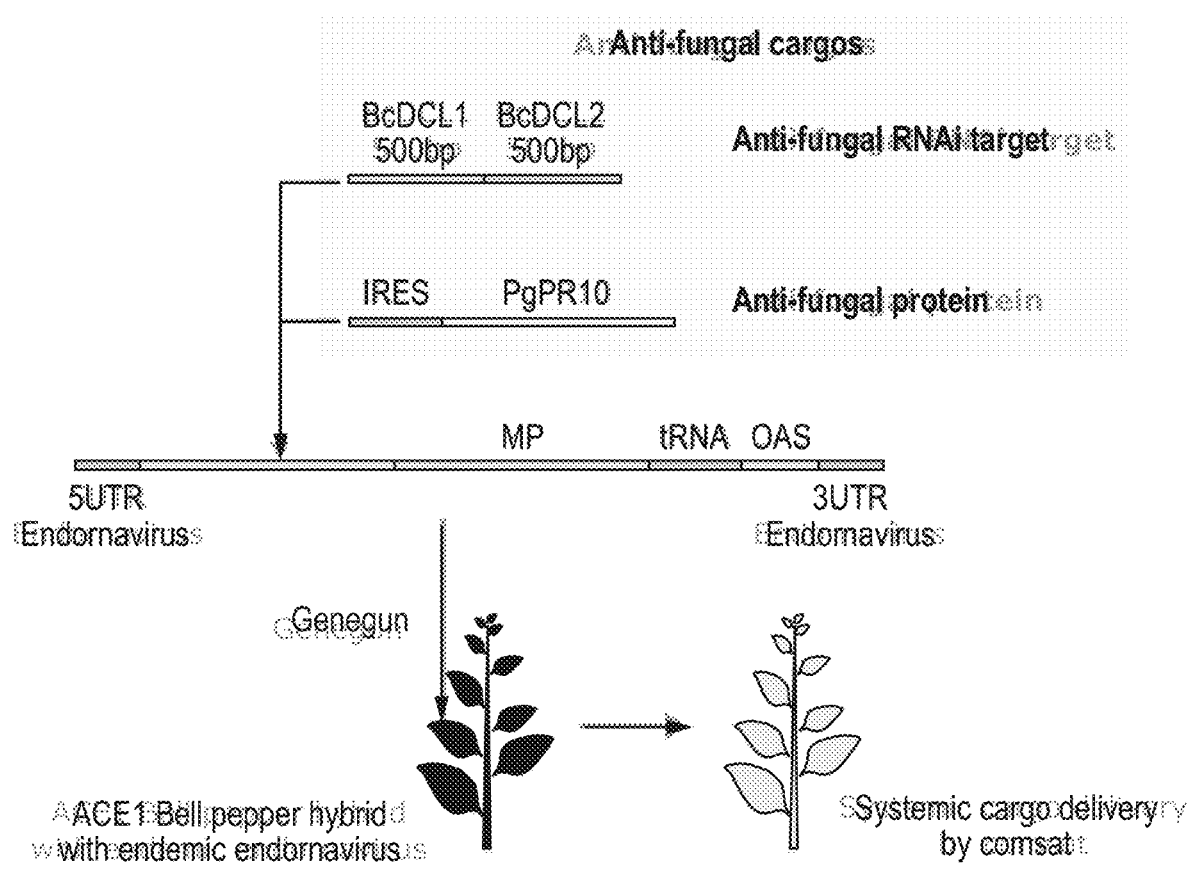
Figure 16:
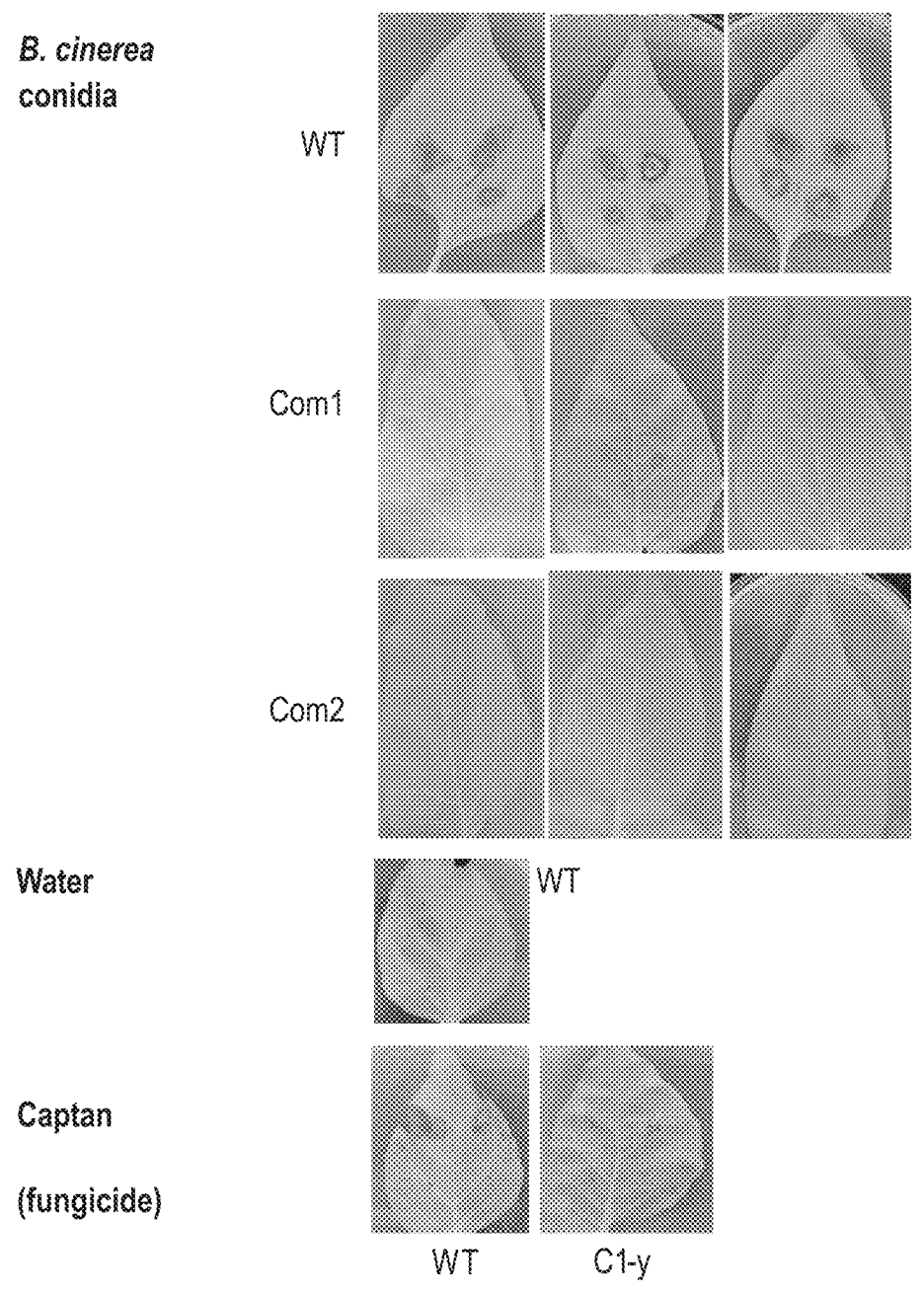

The two second-generation plants with successful vertical transmission were then grown to maturity. Here the antifungal cargo in the RNA satellite should lead to a reduction in viral virulence. Leaves from these plants were harvested and used to perform a *botrytis* challenge assay, using leaves from a wild-type plant as a control. A significant reduction of *botrytis* infection (size and severity of fungal lesions on the detached leaves) was observed in detached leaves of the second-generation plants with positive vertical transmission as compared to leaves of the wild-type control plant. Furthermore, RT-PCR confirmed the presence of the satellite PgPR10 polypeptide-encoding cargo RNA in the second-generation plants with positive vertical transmission. The results of challenging detached leaves of control pepper plants and second-generation pepper plants with systemic distribution of Construct 1 (COM1) or Construct 2 (COM2) as depicted in FIG. 15 are shown in FIG. 16. Resistance to *Botrytis* infection was observed in the detached leaves of second-generation plants with systemic distribution of Construct 1 (COM1) or Construct 2 (COM2).

Example 16. Identification of Rice Endornaviral Sequences

This example describes identification of rice (*Oryza sativa*) endornaviral sequences and embodiments of synthetic endornaviral satellites derived from such sequences. This example further describes endornaviral sequences from Johnsongrass (*Sorghum halepense*) identified by homology to a rice endornaviral genomic sequence.

Sanger sequencing was used to obtain putative endornavirus RdRP sequences from rice (*Oryza sativa*) cultivars M-102 and Colusa, and from these were identified a consensus *Oryza sativa* endornavirus RdRP partial sequence (SEQ ID NO: 455) and the amino acid sequence (SEQ ID NO: 456). Additional sequences identified from the rice cultivars included an *Oryza sativa* Colusa endornavirus RdRP fragment (SEQ ID NO: 457), an *Oryza sativa* M-102 endornavirus sequence identified as a highly conserved non-RdRP domain in the endornaviral polyprotein (SEQ ID NO: 458), and an *Oryza sativa* M102 endornavirus RdRP fragment (SEQ ID NO: 459). Additional NGS sequencing identified from the rice cultivar M-102 a putative *Oryza sativa* endornavirus genome (SEQ ID NO: 460).

In embodiments, synthetic endornaviral satellite RNAs include 5' and/or 3' replicase recognition sequences that include, or are derived from, respectively, the 5' terminal region and 3' terminal region of this novel *Oryza sativa* M-102 endornaviral genome, wherein the 5' and/or 3' replicase recognition sequences permit recognition and replication by an endornaviral RdRP (e.g., the cognate *Oryza sativa* endornaviral RdRP). Such embodiments include, for example, a replicase recognition sequence that includes at least 50, at least 100, at least 150, at least 200, at least 250, at least 300, at least 350, at least 400, at least 450, or at least 500 contiguous nucleotides located in the 5' or 3' terminal regions of the *Oryza sativa* M-102 endornaviral genome. Other embodiments include a replicase recognition sequence of at least 30 nucleotides in length (e.g., at least 30, at least 40, at least 50, at least 60, at least 70, at least 80, at least 90, or at least 100 nucleotides) and having at least 80% (e.g., at least 80%, at least 85%, at least 90%, at least 95%, or at least 98%) sequence identity with a segment of equivalent length located within the 5'-most or 3'-most 500 nucleotides of the *Oryza sativa* M-102 endornaviral genome.

A BLAST search of the *Oryza sativa* M-102 endornavirus genome (SEQ ID NO: 460) against the publicly available NCBI nucleotide database yielded a number of hits including two putative endornaviral sequences isolated from grass blades of Johnsongrass (*Sorghum halepense*). The first *Sorghum halepense* endornavirus (NCBI accession MW756210.1) has the sequence of SEQ ID NO: 461, and included the following genetic elements: (a) a 5'UTR (nucleotides 1-159); (b) a polyprotein (nucleotides 160-13881) comprising a helicase (nucleotides 4684-5433), a capsular polysaccharide synthesis protein (nucleotides 8476-8913), a glycosyl transferase (nucleotides 9412-10425), and an RdRP (nucleotides 12685-13590); and (c) a 3' UTR (nucleotides 13882-13959); the encoded polyprotein has the amino acid sequence of SEQ ID NO: 462.

The second *Sorghum halepense* endornavirus (NCBI accession MW756211.1) has the equivalent RNA sequence of SEQ ID NO: 463, and included the following genetic elements: (a) a 5'UTR (nucleotides 1-159); (b) a polyprotein (nucleotides 160-13881) comprising a helicase (nucleotides 4684-5433), a capsular polysaccharide synthesis protein (nucleotides 8476-8913), a glycosyl transferase (nucleotides 9412-10425), and an RdRP (nucleotides 12616-13608); and (c) a 3' UTR (nucleotides 13882-13950); the encoded polyprotein has the amino acid sequence of SEQ ID NO: 464.

In embodiments, synthetic endornaviral satellite RNAs include 5' and/or 3' replicase recognition sequences that include, or are derived from, respectively, the 5' terminal region and 3' terminal region of a *Sorghum halepense* endornaviral genome such as the two disclosed in this example, wherein the 5' and/or 3' replicase recognition sequences permit recognition and replication by an endornaviral RdRP (e.g., the cognate *Sorghum halepense* endornaviral RdRP). Such embodiments include, for example, a replicase recognition sequence that includes at least 50, at least 100, at least 150, at least 200, at least 250, at least 300, at least 350, at least 400, at least 450, or at least 500 contiguous nucleotides located in the 5' or 3' terminal regions of a *Sorghum halepense* endornaviral genome. Other embodiments include a replicase recognition sequence of at least 30 nucleotides in length (e.g., at least 30, at least 40, at least 50, at least 60, at least 70, at least 80, at least 90, or at least 100 nucleotides) and having at least 80% (e.g., at least 80%, at least 85%, at least 90%, at least 95%, or at least 98%) sequence identity with a segment of equivalent length located within the 5'-most or 3'-most 500 nucleotides of a *Sorghum halepense* endornaviral genome.

Example 17. Identification of Tomato Endornaviral Sequences

This example describes identification of tomato endornaviral sequences and the construction of synthetic endornaviral satellites derived from such sequences. NGS sequencing identified putative *Solanum lycopersicum* endornaviral sequences from the tomato (*Solanum lycopersicum*) cultivars “Rutgers” and “Early Girl” (F1 hybrid). An endornavirus 5' UTR sequence identified from Rutgers tomato included the sequence of SEQ ID NO: 465, which notably includes a segment having the sequence of SEQ ID NO: 466, which has 100% sequence identity with a segment of the bell pepper endornavirus (BPEV) genome. An endornavirus 3' UTR sequence identified from Rutgers tomato had the sequence of SEQ ID NO: 467. An endornavirus RdRP sequence identified from Rutgers tomato had the sequence of SEQ ID NO: 468. An endornavirus RdRP sequence identified from Early Girl (F1) tomato had the sequence of SEQ ID NO: 469.

In embodiments, synthetic endornaviral satellite RNAs include 5' and/or 3' replicase recognition sequences that include, or are derived from, respectively, the 5' terminal region and 3' terminal region of a *Solanum lycopersicum* endornaviral genome, wherein the 5' and/or 3' replicase recognition sequences permit recognition and replication by an endornaviral RdRP (e.g., the cognate *Solanum lycopersicum* endornaviral RdRP). Such embodiments include, for example, a replicase recognition sequence that includes at least 50, at least 100, at least 150, at least 200, at least 250, at least 300, at least 350, at least 400, at least 450, or at least 500 contiguous nucleotides located in the 5' or 3' terminal regions of a *Solanum lycopersicum* endornaviral genome. Other embodiments include a replicase recognition sequence of at least 30 nucleotides in length (e.g., at least 30, at least 40, at least 50, at least 60, at least 70, at least 80, at least 90, or at least 100 nucleotides) and having at least 80% (e.g., at least 80%, at least 85%, at least 90%, at least 95%, or at least 98%) sequence identity with a segment of equivalent length located within the 5'-most or 3'-most 500 nucleotides of a *Solanum lycopersicum* endornaviral genome.

Example 18: Stability of Encapsidated Synthetic Endornaviral Satellite RNAs

This example describes association or complexation of a synthetic endornaviral satellite RNA with a protein, for example by encapsidation of the synthetic endornaviral satellite RNA with a heterologous or non-cognate viral coat protein. This example also illustrates methods of determining stability of the protein-associated endornaviral satellite RNA molecules.

DNA constructs encoding synthetic endornaviral satellite RNAs were designed as follows. The DNA construct “F53” (pT7-5UTR_226 bp-ZmHSP101_IRES-Luc-ZmHSP101_IRES-PMMoVMP-FT-TMVOAS-3UTR_113 bp_w_PolyC_tail, SEQ ID NO: 470) and the DNA construct “F54” (pT7-5UTR_226 bp-ZmHSP101_IRES-Luc-ZmHSP101_IRES-TMVMP-Ile-3UTR_113 bp_w_PolyC_tail, SEQ ID NO: 471) both included, from 5' to 3' orientation, a T7 promoter operably linked to RNA encoding a 226 base-pair 5' replicase recognition sequence and RNA encoding a 113 base-pair 3' replicase recognition sequence, wherein the 5' and 3' replicase recognition sequences flanked a cargo RNA which include an mRNA sequence encoding luciferase (Luc). The DNA construct “F52” (pT7-kozac-Luc, SEQ ID NO: 472), which similarly included a T7 promoter operably linked to an mRNA sequence encoding luciferase, was also transcribed.

RNA samples were generated by in vitro transcription of constructs F52, F53, and F54. The resulting RNA samples were incubated with isolated tobacco mosaic virus coat protein (TMV CP) overnight. The TMV CP-incubated RNA samples were treated with RNase I at 37 degrees Celsius for 15 minutes, followed by enzyme heat inactivation at 70 degrees Celsius for 20 minutes, followed by treatment with Proteinase K at 42 degrees Celsius for one hour. RNA was extracted from the samples, loaded onto 1% agarose TBE gels, run 30 minutes at 110 V, and visualized with ethidium bromide staining. The F52 RNA served as the negative control, as it lacked a TMV OAS and was therefore incapable of encapsidation by TMV CP. TMV genomic RNA served as the positive control, encapsidated by its cognate coat protein. The synthetic endornaviral satellite RNAs containing the TMV OAS and treated with TMV CP were protected from degradation by RNase I, presumably by encapsidation by TMV CP. The non-encapsidated RNAs lacking the TMV OAS were degraded by RNase I. This demonstrated that endornaviral satellite RNAs that are complexed with a protein, e.g., encapsidated by a viral coat protein such as TMV CP, are protected in vitro from ribonuclease degradation and show improved stability, in comparison to RNAs (including endornaviral satellite RNAs) that are not complexed with a protein such as TMV CP.

Separately, encapsidation of the endornaviral satellite RNAs by a heterologous viral coat protein was tested in an in planta stability experiment. Samples of the F53 and F54 endornaviral satellite RNAs as well as the negative control F52 RNA were prepared in 0.1M phosphate buffer and incubated with isolated tobacco mosaic virus coat protein (TMV CP) overnight. The samples were then diluted 1:10, Silwet L-77 was added to 0.05%, and the RNA preparations applied by rubbing onto bell pepper (*Capsicum annuum*, “Ace” F1) leaves. Leaf samples were collected periodically after the RNA application. Antisense Dig-labelled probes were generated from test RNA constructs and used to probe northern blots prepared from the RNA obtained from the leaf samples. The northern blot results indicated that the TMV CP-encapsidated synthetic endornaviral satellite RNAs were stable on the leaf for at least 5 days.

Example 19: Synthetic Endornaviral Satellite RNAs

This example illustrates non-limiting examples of synthetic endornaviral satellite RNAs carrying cargo RNAs with one or more functions, e.g., to effect control of a pest (such as an insect), to effect control of a microbial pathogen (such as a fungal or bacterial pathogen), or to provide a method of selection (e.g., by effecting resistance to a selection agent such as an herbicide). In various embodiments, the cargo RNAs include coding sequence(s), non-coding sequence(s), or both coding and non-coding sequences. In this example the cargo RNAs are carried in synthetic endornaviral satellite RNAs based on a bell pepper (*Capsicum annuum*) endornavirus ("BPEV") genome and would be expected to be amplified by the cognate BPEV RdRP; one of skill would recognize that analogous synthetic endornaviral satellite RNAs can be designed to function with alternative endornaviruses (i.e., with alternative endornaviral RDRPs).

In one example, a synthetic endornaviral satellite RNA carrying an antifungal cargo RNA was designed to include the 5' and 3' replicase recognition sequences for the bell pepper endornavirus (SEQ ID NOs: 580 and 581), and comprised 3242 nucleotides (SEQ ID NO: 473). The components of this construct are provided in Table 16.

TABLE 16

| Genetic element | nucleotide position in SEQ ID NO: 473 |
|---|---|
| BPEV 5' replicase recognition sequence (primer segment) BPEV_5'UTR | 1-226 1-34 |
| Bc_DCL1 (RNAi element targeting *Botrytis cinerea* DCL1) | 231-341 |
| Bc_DCL2 (RNAi element targeting *Botrytis cinerea* DLC2) | 342-579 |
| Bc_Chs1 | 580-771 |
| Bc_Chs3a | 772-1053 |
| Bc_Chs6 | 1054-1207 |
| Bc_Erg1 | 1208-1417 |
| Bc_Erg11 | 1418-1671 |
| Bc_Erg13 | 1672-1880 |
| Bc_EF2 | 1881-2066 |
| ZmHSP101 IRES, TMV movement protein | 2071-3030 |
| Isoleucine tRNA | 3031-3112 |
| BPEV 3' replicase recognition sequence | 3142-3242 |

In another example, a synthetic endoaviral satellite RNA carrying a dual mode-of-action insecticidal cargo RNA (including non-coding dsRNA sequences targeting essential genes of the Colorado potato beetle, *Leptinotarsa decemlineata* and coding sequence for the *Bacillus thuringiensis* insecticidal protein Cry3a) was designed to include the 5' and 3' replicase recognition sequences for the bell pepper endormavirus (SEQ ID NOs: 580 and 581, respectively), and comprised 4004 nucleotides (SEQ ID NO: 474). The components of this construct are provided in Table 17.

TABLE 17

| Genetic element | nucleotide position in SEQ ID NO: 474 |
|---|---|
| BPEV 5' replicase recognition sequence | 1-226 |
| *Leptinotarsa decemlineata* actin 100 bp dsRNA | 561-660 |
| 100 bp dsRNA | 661-760 |
| HC RSV IRES | 761-881 |
| Cry3a CDS | 882-2816 |
| ZmHSP101 IRES | 2821-2967 |
| TMV movement protein | 2974-3780 |
| Isoleucine tRNA | 3781-3862 |

TABLE 17-continued

| Genetic element | nucleotide position in SEQ ID NO: 474 |
|---|---|
| ER VssTrailer6 | 3892-4004 |
| BPEV 3' replicase recognition sequence | 3991-4004 |

In another example, a synthetic endornaviral satellite RNA carrying a multigene cargo RNA (including multiple non-coding dsRNA sequences targeting beet annyworm ("BAW", *Spodoptera exigua*), and multiple non-coding dsRNA sequences targeting the fungus *Botrytis cinerea*) was designed to include the 5' and 3' replicase recognition sequences for the bell pepper endornavirus (SEQ ID NOs: 580 and 581, respectively), and comprised 3034 nucleotides (SEQ ID NO: 475). The components of this construct are provided in Table 18.

TABLE 18

| Genetic element | nucleotide position in SEQ ID NO: 475 |
|---|---|
| BPEV 5' replicase recognition sequence | 1-226 |
| BAW dsRNA1 | 231-390 |
| BAW dsRNA2 | 391-560 |
| BAW dsRNA3 | 561-760 |
| *Botrytis cinerea* DCL1&2 dsRNA | 761-1226 |
| *Botrytis cinerea* dsRNA2 | 1227-1418 |
| *Botrytis cinerea* dsRNA3 | 1419-1672 |
| *Botrytis cinerea* dsRNA4 | 1673-1858 |
| ZmHSP IRES | 1863-2009 |
| TMV movement protein | 2016-2822 |
| tRNA | 2823-2904 |
| BPEV 3' replicase recognition sequence | 2934-3034 |

In another example, a synthetic endoaviral satellite RNA carrying a cargo RNA (including RNA encoding an EPSPS protein providing resistance to the herbicide glyphosate) was designed to include the 5' and 3' replicase recognition sequences for the bell pepper endoavirus (SEQ ID NOs: 580 and 581, respectively), and comprised 3119 nucleotides (SEQ ID NO: 476). The components of this construct are provided in Table 19.

TABLE 19

| Genetic element | nucleotide position in SEQ ID NO: 476 |
|---|---|
| BPEV 5' replicase recognition sequence | 1-226 |
| HcRSV IRES | 227-347 |
| BASTA/glufosinate resistance protein | 348-1931 |
| ZmHSP101 IRES | 1936-2082 |
| TMV movement protein | 2089-2895 |
| Isoleucine tRNA | 2896-2977 |
| BPEV 3' replicase recognition sequence | 3007-3119 |

Example 20: Synthetic Endornaviral Satellite RNAs Encoding an Herbicide Resistance Protein This example illustrates use of a synthetic endornaviral satellite RNA carrying a selectable marker, allowing identification and selection of cells or tissues or plants that contain the satellite RNA. More specifically, this example illustrates use of a selectable herbicide resistance marker (a protein providing glufosinate resistance) and an herbicide selection agent (glufosinate) combination in identifying cells, tissues, or plants that contain the endornaviral satellite RNA. A synthetic endornaviral satellite RNA is used to deliver a cargo RNA encoding an herbicide resistance protein. Expression of the herbicide resistance protein in a plant, or in a plant cell, tissue, or callus, combined with exposure to the corresponding herbicide, provides a method of identification and/or selection of the plant (or plant cell, tissue, or callus) containing the synthetic endornaviral satellite RNA from a population of plants (or plant cells, tissues, or callus). In this non-limiting example the cargo RNAs are carried in synthetic endornaviral satellite RNAs based on a bell pepper (Capsicum annuum) endornavirus ("BPEV") genome and would be expected to be amplified by the cognate BPEV RdRP; one of skill would recognize that analogous synthetic endornaviral satellite RNAs can be designed to function with alternative endornaviruses (i.e., with alternative endornaviral RDRPs), for example, with an endogenous endornavirus in a different plant species.

The non-specific herbicide glufosinate (e.g., a glufosinate-ammonium formulation marketed as "Basta*" by BASF) inhibits the enzyme glutamine synthetase, which leads to plant death through multiple disruptions of the plant metabolism, including the breakdown of photosynthesis. Treated plants generally stop growing within a day after glufosinate application, followed by death about two weeks later. Transgenic plants expressing a bialaphos resistance (bar) or phosphinothricin acyl transferase (pat) enzyme are resistant to glufosinate. In an alternative approach, a synthetic endornaviral satellite RNA was employed to deliver a cargo RNA encoding a protein (e.g., bar or pat) providing glufosinate resistance throughout a plant.

A synthetic endornaviral satellite RNA carrying a cargo RNA (including RNA encoding a protein providing resistance to the non-selective herbicide glufosinate) was designed to include the 5' and 3' replicase recognition sequences for the bell pepper endornavirus (SEQ ID NOs: 580 and 581, respectively), and comprised 2090 nucleotides (SEQ ID NO: 477). The components of this construct are provided in Table 20.

TABLE 20

| Genetic element | nucleotide position in SEQ ID NO: 477 |
| --- | --- |
| BPEV 5' replicase recognition sequence | 1-226 |
| HcRSV IRES | 227-347 |
| BASTA/glufosinate resistance protein | 348-902 |
| ZmHSP101 IRES | 907-1053 |
| TMV movement protein | 1060-1866 |
| Isoleucine tRNA | 1867-1948 |
| BPEV 3' replicase recognition sequence | 1978-2090 |

The TMV movement protein and isoleucine tRNA elements were included to enable movement of the satellite RNA through the plant. The synthetic endornaviral satellite RNA was biolistically delivered into a leaf of a bell pepper (Capsicum annuum) Ace F1 hybrid plant using a gene gun. Two weeks after treatment, samples of leaves both above (n=5 leaves) and below (n=2 leaves) the treated leaf were taken, and RNA extracted. A forward primer (CATCGAGACAAGCACGGTCA, SEQ ID NO: 478) and a reverse primer (CCAGGGACTTCAGCAGATGG, SEQ ID NO: 479) to detect the presence of the cargo glufosinate resistance protein were used to amplify the RNA samples.

Northern blot analysis was performed on the amplified RNA samples. Strong bands corresponding to the predicted cargo RNA amplicon were observed for the RNA samples taken from both of the two leaves below the treated leaf and for the RNA samples taken from four of the five leaves above the treated leaf, with a weaker but still present band observed for the RNA from the fifth leaf above the treated leaf. These results indicated that the cargo sequence had been amplified and systemically distributed throughout the bell pepper plant.

The provision of a selection marker (in this example, a protein that provides tolerance to the herbicide glufosinate) enables selection of cells, tissue, plant parts, intact plants, or propagules that contain the endornaviral satellite RNA. For example, explant material or propagules (e.g., leaf discs, seeds, embryonic tissue, or root or axial or apical meristematic tissue) can be taken from a plant into which the endornaviral satellite RNA has been introduced (e.g., by biolistic delivery, spraying, rubbing, or injection). Such explants or propagules can be cultivated under conditions that select for resistance to the selection marker (in this example, in the presence of the herbicide glufosinate). Explants or propagules that survive under the appropriate selection pressure are expected to contain the selection marker (in this example, the glufosinate resistance protein) and presumably the synthetic endornaviral satellite RNA. In this way, selection for cells, tissue, plant parts, intact plants, or propagules is expected to greatly increase efficiency of production of plants or propagules containing the synthetic endornaviral satellite RNA.

In this example, leaf disc explants were taken from the treated bell pepper plant two weeks after biolistic delivery of the endornaviral satellite RNA. The callus induction and propagation protocol used was based on that described for Capsicum annuum by Kim and Lim (2019) Plant Signaling & Behav., 14:7, DOI: 10.1080/15592324.2019.1604016). Callus formation was induced by placing the leaf disc explants on callus induction medium (B5 medium containing 3% sucrose, 2 mg/L 6-benzylaminopurine, and 1 mg/L alpha-naphthalene acetic acid) under glufosinate (from 0.5 to 8 mg/L) selection. More callus was observed to form from adaxial leaf surfaces than abaxial leaf surfaces. Micro-calli were detached from the leaf discs and transferred to fresh callus induction medium for callus proliferation. Calli are then transferred to shoot induction medium (B5 medium containing 3% sucrose, 2 mg/L 6-benzylaminopurine, 500 mg/L 2-morpholinoethanesulphonic acid and 1.5 mg/L alpha-naphthalene acetic acid) for shoot growth and development. Glufosinate selection is expected to increase the percentage of explants that contain the endornaviral satellite RNA.

Example 21: Synthetic Endornaviral Satellite RNAs Including a Modified 5' Replicase Recognition Sequence This example illustrates a variation of the endornaviral satellite RNA design, wherein the 5' replicase recognition sequence includes nucleotide sequence up to and/or including the endogenous "nick" in the endornaviral genome, and/or including nucleotide sequence extending into the predicted polyprotein coding region.

In embodiments, synthetic endornaviral satellite RNAs including a longer (e.g., at least 400, at least 500, at least 600, at least 700, at least 800, at least 900, or at least 1000 nucleotides) or extended 5' replicase recognition sequence are replicated more efficiently by their cognate endornaviral RdRP than satellite RNAs with a shorter (e.g., ~225 nucleotides or less than about 300 nucleotides or less than about 400 nucleotides) 5' replicase recognition sequence.

In a non-limiting example, a DNA construct encoding a synthetic bell pepper endornavirus (BPEV) satellite RNA included an extended 5' replicase recognition sequence of 1069 nucleotides in length, which encompasses the location of the endogenous "nick" (at nucleotide position 880 in the BPEV genome) as well as extending into the polyprotein coding region; nucleotide changes were made to remove the polyprotein start codon. This endornaviral satellite RNA included a multigene cargo RNA (including non-coding dsRNA targeting the endogenous *Capsicum annuum* phytoene desaturase (PDS) gene, and non-coding dsRNA targeting Colorado potato beetle, *Leptinotarsa decemlineata*). The DNA construct encoding the endornaviral satellite RNA comprised 2906 nucleotides (SEQ ID NO: 480). The components of this construct are provided in Table 21.

TABLE 21

| Genetic element | nucleotide position in SEQ ID NO: 480 |
|---|---|
| T7 promoter sequence | 1-18 |
| BPEV 5'UTR extended to endogenous “nick” and into polyprotein region (BPEV 5' replicase recognition sequence) | 19-1087 |
| *Capsicum annuum* PDS dsRNA | 1088-1408 |
| *Leptinotarsa decemlineata* dsRNA | 1409-1714 |
| ZmHSP IRES | 1723-1869 |
| TMV movement protein | 1876-2682 |
| Isoleucine tRNA | 1683-2764 |
| BPEV 3' UTR (BPEV 3' replicase recognition sequence) | 2794-2906 |

The *Capsicum annuum* PDS dsRNA serves as a selectable marker (see, e.g., Example 20), which in this case is expected to produce a bleached phenotype where the PDS dsRNA is expressed. The bleached phenotype is useful as a visual marker for systemic movement of the endornaviral satellite RNA, and furthermore is useful for the identification and selection of cells or tissues or plants that contain the satellite RNA.

Example 22: Anti-Fungal Activity of Synthetic Endornaviral Satellite RNA Cargo dsRNA Sequences This example describes preliminary in vitro testing of cargo RNA sequences designed to inhibit growth of the fungus *Botrytis cinerea*, an important plant pathogen. The assays described can be employed to select active antifungal molecules (e.g., dsRNAs for suppression of a specific target gene, or polypeptides with antifungal activity) which can then be encoded and delivered as an endornaviral satellite cargo.

Anti-fungal activity was evaluated using a resazurin dye (PrestoBlue® Cell Viability Reagent, ThermoScientific Catalogue number A13261) colorimetric assay. The PrestoBlue® dye is a cell-permeable, quantitative cell viability indicator that is reduced by cellular reductases in living cells to a fluorescent derivative. A general protocol is as follows. Conidia of *Botrytis cinerea* (strain bcl) were isolated from a 2-week-old Sabouraud Maltose Agar (SMA) culture, suspended in 10% grape juice, and 5 microliter aliquots containing 3000 conidia were transferred into wells of a 96-well plate, each well further containing 25 microliters 1% Sabouraud Maltose Broth (SMB), 15 microliters distilled water, and 5 microliters of the test solution (or nuclease-free water as a negative control) for a final volume of 50 microliters/well. The commercial fungicide Captan (diluted 1:20) is used as a positive control. The plate is sealed with Parafilm and incubated 24 h in a shaker (100 rpm) at 23 degrees Celsius. Spore germination was evaluated by microscopy, followed by resazurin treatment. Ten microliters PrestoBlue™ Cell Viability Reagent (ThermoScientific Cat #A13261) and 40 microliters of SMB were added per well, and the plate further incubated in the shaker for 12-15 hours. Color changes in wells were recorded by imaging and fluorescence was measured with excitation wavelength of 560 nm and emission wavelength of 600 nm.

Double-stranded RNAs were synthesized by in vitro transcription of selected PCR amplicons from the synthetic endornaviral satellite RNAs described in Example 19. The dsRNAs were purified, denatured 10 minutes at 70 degrees Celsius, and then incubated 5 minutes at room temperature to anneal before testing.

The dsRNAs included (1) *Botrytis cinerea* DCL1&2 dsRNA, (2) a multigene cargo (“MGC”) dsRNA including dsRNA sequences individually targeting Colorado potato beetle (*Leptinotarsa decemlineata*), beet armyworm (*Spodoptera exigua*), and *Botrytis cinerea*, and (3) green fluorescent protein (GFP) dsRNA as a control dsRNA.

In one experiment, 24 h incubation with the test agents was followed by 17 h incubation with resazurin. *Botrytis cinerea* DCL1&2 dsRNA (10 micrograms/well) was observed to suppress *B. cinerea* conidial germination and growth. MGC dsRNA in the same amount (10 micrograms/well) did not inhibit fungal growth, possibly because the *B. cinerea* dsRNA sequence is only a fraction of the total dsRNA. Similar results were observed in a second experiment which used 36 h incubation with the test agents, followed by 15 h incubation with resazurin. However, longer (48-63 h) incubation times with the *Botrytis cinerea* DCL1&2 dsRNA (10 micrograms/well) did not suppress fungal growth. In an additional experiment, 24 h incubation with a higher dose (20 micrograms/well) of the MGC dsRNA, followed by 17 h incubation with resazurin, resulted in inhibition of fungal growth.

In another experiment, delay in fungal growth was evaluated by microscopic image analysis of *B. cinerea* conidia (2000/well) treated for 15 hours with 10 or 20 micrograms/well MGC dsRNA. Fifteen days after dsRNA treatment, hyphal filament length was measured for at least ten filaments in each well, with three technical replicate wells per treatment. Mean hyphal length for the blank (water) control was 195.7 (SD=4) micrometers and 197.3 (SD=24.1) micrometers for wells treated with GFP dsRNA (negative control). A dose-dependent decrease of fungal hyphal length was observed with mean hyphal lengths of 159.3 (SD=16.6) micrometers for the 15 microgram/well treatment and 105.7 (SD=29.2) micrometers for the 20 microgram/well treatment, indicating that the MGC dsRNA decreased fungal growth rates at least at the higher concentrations. A resazurin assay was carried out using 24 h incubation with 20 micrograms/well MGC dsRNA, followed by 15 h incubation with resazurin; this higher dose of MGC dsRNA was again observed to reduce fungal growth.

These results indicate that the resazurin assay and the hyphal growth measurements can be employed to evaluate activity of the dsRNA sequences carried as cargo by synthetic endornaviral satellite RNAs.

Example 23: Synthetic Endornaviral Satellite RNAs Including Genetic Elements for Enhanced Expression This example illustrates embodiments of endornaviral satellite RNAs which include genetic elements to enhance expression. Expression-enhancing elements that enhance translation of coding sequence (e.g., a messenger RNA sequence) are known as "translational enhancers". Non-limiting examples of translational enhancers that can be used with the synthetic endornaviral satellite RNAs of this disclosure include sequences from plant viruses and animal viruses; see, e.g., Gallie et al. (1987) *Nucleic Acids Res.,* 15:3257-3273; DOI:10.1093/nar/15.8.3257; Pfeiffer et al. (2012) *Proc. Natl. Acad. Sci. USA,* 109_6626-6631; DOI: 10.1073/pnas.1204520109.

In a non-limiting example, a DNA construct encoding a synthetic bell pepper endornavirus (BPEV) satellite RNA included the translational enhancer "Omega" leader sequence from the 5' UTR of tobacco mosaic virus (see Gallie et al. (1987) *Nucleic Acids Res.,* 15:3257-3273; DOI:10.1093/nar/15.8.3257), which is expected to further enhance expression of the adjacent heterologous cargo RNA sequence, which in this example included coding sequence for "superfolder" green fluorescent protein (sfGFP; see Pédelacq et al. (2006) *Nature Biotechnol.,* 24:79-88; DOI: 10.1038/nbt1172). The DNA construct encoding the endornaviral satellite RNA comprised 2242 nucleotides (SEQ ID NO: 481). The components of this construct are provided in Table 22.

TABLE 22

| Genetic element | nucleotide position in SEQ ID NO: 481 |
|---|---|
| T7 promoter sequence | 1-29 |
| BPEV 5' replicase recognition sequence | 30-225 |
| TMV "omega" sequence | 256-310 |
| sfGFP | 311-1054 |
| ZmHSP101 IRES | 1059-1205 |

TABLE 22-continued

| Genetic element | nucleotide position in SEQ ID NO: 481 |
|---|---|
| TMV movement protein | 1212-2018 |
| Isoleucine tRNA | 2019-2100 |
| BPEV 3' replicase recognition sequence with poly-C tail | 2130-2242 |

In another non-limiting example, a DNA construct encoding a synthetic bell pepper endornavirus (BPEV) satellite RNA included a tobacco etch virus (TEV) IRES to enhance expression of the adjacent heterologous cargo RNA sequence, which in this example included coding sequence for "superfolder" green fluorescent protein. The DNA construct encoding the endornaviral satellite RNA comprised 2330 nucleotides (SEQ ID NO: 482). The components of this construct are provided in Table 23.

TABLE 23

| Genetic element | nucleotide position in SEQ ID NO: 482 |
|---|---|
| T7 promoter sequence | 1-29 |
| BPEV 5' replicase recognition sequence | 30-255 |
| TEV IRES | 256-398 |
| sfGFP | 399-1142 |
| ZmHSP101 IRES | 1147-1293 |
| TMV movement protein | 1300-2106 |
| Isoleucine tRNA | 2107-2188 |
| BPEV 3' replicase recognition sequence with poly-C tail | 2218-2330 |

Listings of Biological Sequences

TABLE 1

Endornavirus 5' and 3' replicase recognition sequences comprising Endornavirus 5' and 3' UTRs

| Name | Sequences[1] | |
|---|---|---|
| endo5UTR consensus >endFiveUTRMSA-consensus | SEQ ID NO: 1 | |
| endornavirus | 5' replicase recognition sequence (5'-most 500 bases) | 5' replicase recognition sequence |
| Oryza sativa endornavirus >NC_007647 | SEQ ID NO: 2 | |
| Vicia faba endornavirus >NC_007648 | SEQ ID NO: 3 | |
| Oryza rufipogon endornavirus >NC_007649 | SEQ ID NO: 4 | |
| Persea americana endornavirus >NC_016648 | SEQ ID NO: 5 | |
| Lagenaria siceraria endornavirus >NC_023641 | SEQ ID NO: 6 | |
| Yerba mate endornavirus strain INTA >NC_024455 | SEQ ID NO: 7 | |
| Hot pepper alphaendornavirus >NC_027920 | SEQ ID NO: 8 | |
| Hordeum vulgare endornavirus >NC_028949 | SEQ ID NO: 9 | |

TABLE 1-continued

Endornavirus 5' and 3' replicase recognition sequences comprising Endornavirus 5' and 3' UTRs

| Name | Sequences[1] | |
|---|---|---|
| Cucumis melo endornavirus isolate CL-01 >NC_029064 | SEQ ID NO: 10 | |
| Winged bean alphaendornavirus 1 >NC_031336 | SEQ ID NO: 11 | SEQ ID NO: 378 |
| Lagenaria siceraria endornavirus Hubei isolate >NC_034216 | SEQ ID NO: 12 | GTA |
| Phaseolus vulgaris endornavirus 2 isolate PvEV-2 >NC_038422 | SEQ ID NO: 13 | |
| Bell pepper endornavirus isolate Penol >NC_039216 | SEQ ID NO: 14 | SEQ ID NO: 376 |
| Phaseolus vulgaris alphaendornavirus 1 isolate PvEV-1 >NC_039217 | SEQ ID NO: 15 | |
| Phaseolus endornavirus 3 isolate LA >NC_040558 | SEQ ID NO: 16 | GGGGAAAT |
| Helianthus annuus alphaendornavirus isolate BJ >NC_040799 | SEQ ID NO: 17 | SEQ ID NO: 404 |
| Cluster bean endornavirus isolate: 593049 >NC_040825 | SEQ ID NO: 18 | SEQ ID NO: 379 |
| Basella alba endornavirus 1, BaEV1 >NC_043109 | SEQ ID NO: 19 | |
| Bell pepper endornavirus >AB597230 | | SEQ ID NO: 372 |
| Cucumis melo endornavirus isolate CL-01 >NC_029064 | | GGTA |
| Bell pepper endornavirus isolate Maor >KP455654 | | SEQ ID NO: 373 |
| Bell pepper endornavirus >KT149366 | | SEQ ID NO: 374 |
| Bell pepper endornavirus isolate BPEV-YW >JN019858 | | SEQ ID NO: 375 |
| Persea americana endornavirus isolate Fuerte >JN880414 | | GTA |
| Bell pepper endornavirus isolate 1j >KF709944 | | SEQ ID NO: 377 |
| Oryza sativa endornavirus >D32136 | | TGAA |
| Oryza rufipogon endornavirus >AB014344 | | TGAA |
| Cucumber endornavirus 1 isolate CuEV1 >MT586998 | | SEQ ID NO: 380 |
| Bell pepper endornavirus strain IS >JQ951943 | | SEQ ID NO: 381 |
| Fagopyrum esculentum endornavirus 2 isolate SK >MZ517186 | | SEQ ID NO: 382 |

TABLE 1-continued

Endornavirus 5' and 3' replicase recognition sequences comprising Endornavirus 5' and 3' UTRs

| Name | Sequences[1] |
|---|---|
| Capsicum frutescens endornavirus 1 isolate LA-C >MT013202 | SEQ ID NO: 383 |
| Cucumis melo alphaendornavirus strain CmEV/BRA/TO-23/2014 >MH365458 | SEQ ID NO: 384 |
| Bell pepper alphaendornavirus isolate Antioquia May 5 >MN073197 | SEQ ID NO: 385 |
| Capsicum frutescens endornavirus 1 isolate LA-A >MT013200 | SEQ ID NO: 386 |
| Capsicum frutescens endornavirus 1 isolate LA-B >MT013201 | TAAAAAGGT |
| Plant associated alphaendornavirus 1 isolate BER19SW1 >OL472077 | SEQ ID NO: 387 |
| Tomato associated alphaendornavirus 1 isolate BOL20S >OL472079 | GTCAAG |
| Bell pepper alphaendornavirus isolate MS1 >MN175323 | SEQ ID NO: 388 |
| Brown algae endornavirus 1 Chiba1 >LC521321 | GTCTCAAG |
| Brown algae endornavirus 2 Chiba2 >LC521322 | ACA |
| Bell pepper alphaendornavirus isolate BPEV_Panama >MZ127290 | SEQ ID NO: 389 |
| Lily alphaendornavirus isolate BJ >MZ614632 | SEQ ID NO: 390 |
| Phaseolus vulgaris alphaendornavirus 2 >OM112199 | SEQ ID NO: 391 |
| Basella alba alphaendornavirus strain Oahu4 >OM108480 | AAT |
| Pumpkin alphaendornavirus isolate Anhui >MW018478 | SEQ ID NO: 392 |
| Oryza sativa alphaendornavirus isolate BXCFS134 >MZ209990 | SEQ ID NO: 393 |
| Oryza sativa alphaendornavirus isolate DHCFY127945 >MZ209614 | SEQ ID NO: 394 |
| Pterostylis alphaendornavirus strain HR >OL471320 | SEQ ID NO: 395 |
| Bell pepper alphaendornavirus isolate LA-E >MT013204 | SEQ ID NO: 396 |
| Triticeae associated alphaendornavirus isolate Wheeler >MW091544 | SEQ ID NO: 397 |

TABLE 1-continued

Endornavirus 5' and 3' replicase recognition sequences comprising Endornavirus 5' and 3' UTRs

| Name | Sequences[1] |
|---|---|
| Hordeum vulgare alphaendornavirus isolate HYT-37 >MN107382 | SEQ ID NO: 398 |
| Hordeum vulgare alphaendornavirus isolate HYT-38 >MN107383 | SEQ ID NO: 399 |
| Cucumis melo alphaendornavirus isolate IL >MN398900 | TTCCGTA |
| Phaseolus vulgaris alphaendornavirus 1 isolate PVAV1/CG6 >MN832719 | SEQ ID NO: 400 |
| Phaseolus vulgaris alphaendornavirus 2 isolate PVAV2/CG6 >MN832720 | SEQ ID NO: 401 |
| Bell pepper alphaendornavirus isolate XJ >MH182675 | SEQ ID NO: 402 |
| Bell pepper alphaendornavirus isolate Marinilla >MK284997 | SEQ ID NO: 403 |
| Bell pepper alphaendornavirus isolate San Vicente >MK284998 | GGTTTT |
| Bell pepper alphaendornavirus isolate May8A >MK116548 | SEQ ID NO: 405 |
| Endornavirus identified from rice cultivar M-102 | SEQ ID NO: 483 |
| Johnsongrass virus isolate JVG-1 >MW756210 | SEQ ID NO: 484 |
| Johnsongrass virus isolate JVG-2 >MW756211 | SEQ ID NO: 485 |
| Endornavirus identified from Rutgers tomato | SEQ ID NO: 465 |
| endo3UTR consensus >endThreeUTRMSA-consensus | SEQ ID NO: 20 |

| endornavirus | 3' replicase recognition sequence (3'-most 500 bases) | 3' replicase recognition sequence |
|---|---|---|
| Oryza sativa endornavirus >NC_007647 | SEQ ID NO: 21 | |
| Vicia faba endornavirus >NC_007648 | SEQ ID NO: 22 | |
| Oryza rufipogen endornavirus >NC_007649 | SEQ ID NO: 23 | |
| Persea americana endornavirus >NC_016648 | SEQ ID NO: 24 | |
| Lagenaria siceraria endornavirus, LsEV >NC_023641 | SEQ ID NO: 25 | |
| Yerba mate endornavirus strain INTA >NC_024455 | SEQ ID NO: 26 | |
| Hot pepper alphaendornavirus >NC_027920 | SEQ ID NO: 27 | |

TABLE 1-continued

Endornavirus 5' and 3' replicase recognition sequences comprising Endornavirus 5' and 3' UTRs

| Name | Sequences[1] | |
|---|---|---|
| Hordeum vulgare endornavirus<br>>NC_028949 | SEQ ID NO: 28 | |
| Cucumis melo endornavirus isolate CL-01<br>>NC_029064 | SEQ ID NO: 29 | |
| Winged bean alphaendornavirus 1<br>>NC_031336 | SEQ ID NO: 30 | SEQ ID NO: 415 |
| Lagenaria siceraria endornavirus-Hubei<br>>NC_034216 | SEQ ID NO: 31 | SEQ ID NO: 452 |
| Phaseolus vulgaris endornavirus 2 isolate PvEV-2<br>>NC_038422 | SEQ ID NO: 32 | |
| Bell pepper endornavirus isolate Penol<br>>NC_039216 | SEQ ID NO: 33 | SEQ ID NO: 411 |
| Phaseolus vulgaris alphaendornavirus 1<br>>NC_039217 | SEQ ID NO: 34 | |
| Phaseolus endornavirus 3 isolate LA<br>>NC_040558 | SEQ ID NO: 35 | SEQ ID NO: 412 |
| Helianthus annuus alphaendornavirus isolate BJ<br>>NC_040799 | SEQ ID NO: 36 | SEQ ID NO: 450 |
| Cluster bean endornavirus 1<br>>NC_040825 | SEQ ID NO: 37 | SEQ ID NO: 416 |
| Basella alba endornavirus 1, baEV1<br>>NC_043109 | SEQ ID NO: 38 | |
| Bell pepper endornavirus<br>>AB597230 | | SEQ ID NO: 406 |
| Cucumis melo endornavirus isolate CL-01<br>>NC_029064 | | SEQ ID NO: 407 |
| Bell pepper endornavirus isolate Maor<br>>KP455654 | | SEQ ID NO: 408 |
| Bell pepper endornavirus<br>>KT149366 | | SEQ ID NO: 409 |
| Bell pepper endornavirus isolate BPEV-YW<br>>JN019858 | | SEQ ID NO: 410 |
| Persea americana endornavirus isolate Fuerte<br>>JN880414 | | SEQ ID NO: 413 |
| Bell pepper endornavirus isolate lj<br>>KF709944 | | SEQ ID NO: 414 |
| Oryza sativa endornavirus<br>>D32136 | | SEQ ID NO: 417 |
| Oryza rufipogon endornavirus<br>>AB014344 | | SEQ ID NO: 418 |
| Cucumber endornavirus 1 isolate CuEV1<br>>MT586998 | | SEQ ID NO: 419 |
| Bell pepper endornavirus strain IS<br>>JQ951943 | | SEQ ID NO: 420 |
| Fagopyrum esculentum endornavirus 2 isolate SK<br>>MZ517186 | | SEQ ID NO: 421 |

TABLE 1-continued

Endornavirus 5' and 3' replicase recognition sequences comprising Endornavirus 5' and 3' UTRs

| Name | Sequences[1] |
|---|---|
| Capsicum frutescens endornavirus 1 isolate LA-C<br>>MT013202 | SEQ ID NO: 422 |
| Cucumis melo alphaendornavirus strain CmEV/BRA/TO-23/2014<br>>MH365458 | SEQ ID NO: 423 |
| Bell pepper alphaendornavirus isolate Antioquia May 5<br>>MN073197 | SEQ ID NO: 424 |
| Capsicum frutescens endornavirus 1 isolate LA-A<br>>MT013200 | SEQ ID NO: 425 |
| Capsicum frutescens endornavirus 1 isolate LA-B<br>>MT013201 | SEQ ID NO: 426 |
| Plant associated alphaendornavirus 1 isolate BER19SW1<br>>OL472077 | SEQ ID NO: 427 |
| Tomato associated alphaendornavirus 1 isolate BOL20S<br>>OL472079 | SEQ ID NO: 428 |
| Bell pepper alphaendornavirus isolate MS1<br>>MN175323 | SEQ ID NO: 429 |
| Brown algae endornavirus 1 Chiba1<br>>LC521321 | SEQ ID NO: 430 |
| Brown algae endornavirus 2 Chiba2<br>>LC521322 | SEQ ID NO: 431 |
| Bell pepper alphaendornavirus isolate BPEV_Panama<br>>MZ127290 | SEQ ID NO: 432 |
| Lily alphaendornavirus isolate BJ<br>>MZ614632 | SEQ ID NO: 433 |
| Phaseolus vulgaris alphaendornavirus 2<br>>OM112199 | SEQ ID NO: 434 |
| Basella alba alphaendornavirus strain Oahu4<br>>OM108480 | SEQ ID NO: 435 |
| Pumpkin alphaendornavirus isolate Anhui<br>>MW018478 | SEQ ID NO: 436 |
| Oryza sativa alphaendornavirus isolate BXCFS134<br>>MZ209990 | SEQ ID NO: 437 |
| Oryza sativa alphaendornavirus isolate DHCFY127945<br>>MZ209614 | SEQ ID NO: 438 |
| Pterostylis alphaendornavirus strain HR<br>>OL471320 | SEQ ID NO: 439 |
| Bell pepper alphaendornavirus isolate LA-E<br>>MT013204 | SEQ ID NO: 440 |
| Triticeae associated alphaendornavirus isolate Wheeler<br>>MW091544 | SEQ ID NO: 441 |

TABLE 1-continued

Endornavirus 5' and 3' replicase recognition sequences comprising Endornavirus 5' and 3' UTRs

| Name | Sequences[1] |
|---|---|
| Hordeum vulgare alphaendornavirus isolate HYT-37 >MN107382 | SEQ ID NO: 442 |
| Hordeum vulgare alphaendornavirus isolate HYT-38 >MN107383 | SEQ ID NO: 443 |
| Cucumis melo alphaendornavirus isolate IL >MN398900 | SEQ ID NO: 444 |
| Phaseolus vulgaris alphaendornavirus 1 isolate PVAV1/CG6 >MN832719 | SEQ ID NO: 445 |
| Phaseolus vulgaris alphaendornavirus 2 isolate PVAV2/CG6 >MN832720 | SEQ ID NO: 446 |
| Bell pepper alphaendornavirus isolate XJ >MH182675 | SEQ ID NO: 447 |
| Bell pepper alphaendornavirus isolate Marinilla >MK284997 | SEQ ID NO: 448 |
| Bell pepper alphaendornavirus isolate San Vicente >MK284998 | SEQ ID NO: 449 |
| Bell pepper alphaendornavirus isolate May8A >MK116548 | SEQ ID NO: 451 |
| Capsicum frutescens endornavirus 1 isolate MC7 >MN175322 | SEQ ID NO: 453 |
| Geranium carolinianum endornavirus >MH577297 | SEQ ID NO: 454 |
| Endornavirus identified from rice cultivar M-102 | SEQ ID NO: 486 |
| Johnsongrass virus isolate JVG-1 >MW756210 | SEQ ID NO: 487 |
| Johnsongrass virus isolate JVG-2 >MW756211 | SEQ ID NO: 488 |
| Endornavirus identified from Rutgers tomato | SEQ ID NO: 467 |

[1]SEQ ID NO correspond to DNA molecules which encode the corresponding RNA molecules present in certain recombinant RNA molecules provided herein.

TABLE 2

Viral coat protein and origin of assembly sequences

| Virus | Origin of assembly sequence | Coat Protein |
|---|---|---|
| NC_001367.1 | Tobacco mosaic virus, complete genome| Tobacco mosaic virus | SEQ ID NO: 39 | SEQ ID NO: 64 |
| NC_001556.1 | Tobacco mild green mosaic virus, complete genome| Tobacco mild green mosaic virus | SEQ ID NO: 40 | SEQ ID NO: 65 |
| NC_002692.1 |Tomato mosaic virus, complete genome| Tomato mosaic virus | SEQ ID NO: 41 | SEQ ID NO: 66 |
| NC_003630.1 |Pepper mild mottle virus, complete genome| Pepper mild mottle virus | SEQ ID NO: 42 | SEQ ID NO: 67 |
| NC_004106.1 |Paprika mild mottle virus, complete genome|Paprika mild mottle virus | SEQ ID NO: 43 | SEQ ID NO: 68 |
| NC_009642.1 |Bell pepper mottle tobamovirus, complete genome|Bell pepper mottle virus | SEQ ID NO: 44 | SEQ ID NO: 69 |

TABLE 2-continued

Viral coat protein and origin of assembly sequences

| Virus | Origin of assembly sequence | Coat Protein |
|---|---|---|
| NC_022230.1 \|Tomato mottle mosaic virus isolate MX5, complete genome\|Tomato mottle mosaic virus | SEQ ID NO: 45 | SEQ ID NO: 70 |
| NC_001728.1 \|Odontoglossum ringspot virus, complete genome\|Odontoglossum ringspot virus | SEQ ID NO: 46 | SEQ ID NO: 71 |
| NC_003852.1 \|Obuda pepper virus, complete genome\|Obuda pepper virus | SEQ ID NO: 47 | SEQ ID NO: 72 |
| NC_009041.1 \|Rehmannia mosaic virus, complete genome\|Rehmannia mosaic virus | SEQ ID NO: 48 | SEQ ID NO: 73 |
| NC_010944.1 \|Brugmansia mild mottle virus, complete genome\|Brugmansia mild mottle virus | SEQ ID NO: 49 | SEQ ID NO: 74 |
| NC_022801.1 \|Yellow tailflower mild mottle virus isolate Cervantes, complete genome\|Yellow tailflower mild mottle virus | SEQ ID NO: 50 | SEQ ID NO: 75 |
| NC_030229.1 \|Tropical soda apple mosaic virus isolate Okeechobee, complete genome\|Tropical soda apple mosaic virus | SEQ ID NO: 51 | SEQ ID NO: 76 |
| NC_001801.1 \|Cucumber green mottle mosaic virus, complete genome\|Cucumber green mottle mosaic virus | SEQ ID NO: 52 | SEQ ID NO: 77 |
| NC_002633.1 \|Cucumber fruit mottle mosaic virus, complete genome\|Cucumber fruit mottle mosaic virus | SEQ ID NO: 53 | SEQ ID NO: 78 |
| NC_003610.1 \|Kyuri green mottle mosaic virus, complete genome\|Kyuri green mottle mosaic virus | SEQ ID NO: 54 | SEQ ID NO: 79 |
| NC_003878.1 \|Zucchini green mottle mosaic virus, complete genome\|Zucchini green mottle mosaic virus | SEQ ID NO: 55 | SEQ ID NO: 80 |
| NC_008614.1 \|Cucumber mottle virus, complete genome\|Cucumber mottle virus | SEQ ID NO: 56 | SEQ ID NO: 81 |
| watermelon green mottle mosaic virus | SEQ ID NO: 57 | SEQ ID NO: 82 |
| NC_001873.1 \|Turnip vein-clearing virus, complete genome\|Turnip vein-clearing virus | SEQ ID NO: 58 | SEQ ID NO: 83 |
| NC_002792.2 \|Ribgrass mosaic virus, complete genome\|Ribgrass mosaic virus | SEQ ID NO: 59 | SEQ ID NO: 84 |
| NC_003355.1 \|Wasabi mottle virus, complete genome\|Wasabi mottle virus | SEQ ID NO: 60 | SEQ ID NO: 85 |
| NC_004422.1 \|Youcai mosaic virus, complete genome\|Youcai mosaic virus | SEQ ID NO: 61 | SEQ ID NO: 86 |
| NC_008365.1 \|Streptocarpus flower break virus, complete genome\|Streptocarpus flower break virus | SEQ ID NO: 62 | SEQ ID NO: 87 |
| NC_016442.1 \|Rattail cactus necrosis associated virus, complete genome\|Rattail cactus necrosis-associated virus | SEQ ID NO: 63 | SEQ ID NO: 88 |

TABLE 3

Movement proteins

| Virus | Movement protein |
|---|---|
| NC_001367.1 \|Tobacco mosaic virus, complete genome\|Tobacco mosaic virus | SEQ ID NO: 89 |
| NC_001556.1 \|Tobacco mild green mosaic virus, complete genome\|Tobacco mild green mosaic virus | SEQ ID NO: 90 |
| NC_002692.1 \|Tomato mosaic virus, complete genome\|Tomato mosaic virus | SEQ ID NO: 91 |
| NC_003630.1 \|Pepper mild mottle virus, complete genome\|Pepper mild mottle virus | SEQ ID NO: 92 |
| NC_004106.1 \|Paprika mild mottle virus, complete genome\|Paprika mild mottle virus | SEQ ID NO: 93 |
| NC_009642.1 \|Bell pepper mottle tobamovirus, complete genome\|Bell pepper mottle virus | SEQ ID NO: 94 |
| NC_022230.1 \|Tomato mottle mosaic virus isolate MX5, complete genome\|Tomato mottle mosaic virus | SEQ ID NO: 95 |
| NC_001728.1 \|Odontoglossum ringspot virus, complete genome\|Odontoglossum ringspot virus | SEQ ID NO: 96 |
| NC_003852.1 \|Obuda pepper virus, complete genome\|Obuda pepper virus | SEQ ID NO: 97 |
| NC_009041.1 \|Rehmannia mosaic virus, complete genome\|Rehmannia mosaic virus | SEQ ID NO: 98 |
| NC_010944.1 \|Brugmansia mild mottle virus, complete genome\|Brugmansia mild mottle virus | SEQ ID NO: 99 |
| NC_022801.1 \|Yellow tailflower mild mottle virus isolate Cervantes, complete genome\|Yellow tailflower mild mottle virus | SEQ ID NO: 100 |
| NC_030229.1 \|Tropical soda apple mosaic virus isolate Okeechobee, complete genome\|Tropical soda apple mosaic virus | SEQ ID NO: 101 |
| NC_001801.1 \|Cucumber green mottle mosaic virus, complete genome\|Cucumber green mottle mosaic virus | SEQ ID NO: 102 |
| NC_002633.1 \|Cucumber fruit mottle mosaic virus, complete genome\|Cucumber fruit mottle mosaic virus | SEQ ID NO: 103 |
| NC_003610.1 \|Kyuri green mottle mosaic virus, complete genome\|Kyuri green mottle mosaic virus | SEQ ID NO: 104 |
| NC_003878.1 \|Zucchini green mottle mosaic virus, complete genome\|Zucchini green mottle mosaic virus | SEQ ID NO: 105 |
| NC_008614.1 \|Cucumber mottle virus, complete genome\|Cucumber mottle virus | SEQ ID NO: 106 |
| watermelon green mottle mosaic virus | SEQ ID NO: 107 |
| NC_001873.1 \|Turnip vein-clearing virus, complete genome\|Turnip vein-clearing virus | SEQ ID NO: 108 |
| NC_002792.2 \|Ribgrass mosaic virus, complete genome\|Ribgrass mosaic virus | SEQ ID NO: 109 |
| NC_003355.1 \|Wasabi mottle virus, complete genome\|Wasabi mottle virus | SEQ ID NO: 110 |
| NC_004422.1 \|Youcai mosaic virus, complete genome\|Youcai mosaic virus | SEQ ID NO: 111 |
| NC_008365.1 \|Streptocarpus flower break virus, complete genome\|Streptocarpus flower break virus | SEQ ID NO: 112 |
| NC_016442.1 \|Rattail cactus necrosis associated virus, complete genome\|Rattail cactus necrosis-associated virus | SEQ ID NO: 113 |

TABLE 4 tRNA-like sequences

| Name | Sequence[1] |
|---|---|
| >AT1G59870.1 | SEQ ID NO: 114 |
| >AT1G71697.1 | SEQ ID NO: 115 |
| >AT1G77885.1 | SEQ ID NO: 116 |
| >AT2G04400.1 | SEQ ID NO: 117 |
| >AT2G20230.1 | SEQ ID NO: 118 |
| >AT2G24790.1 | SEQ ID NO: 119 |
| >AT2G32540.1 | SEQ ID NO: 120 |
| >AT3G15850.1 | SEQ ID NO: 121 |
| >AT3G25770.1 | SEQ ID NO: 122 |
| >AT4G15570.1 | SEQ ID NO: 123 |
| >AT4G26050.1 | SEQ ID NO: 124 |
| >AT4G26050.1 | SEQ ID NO: 125 |
| >AT4G27430.2 | SEQ ID NO: 126 |
| >AT4G27430.2 | SEQ ID NO: 127 |

TABLE 4-continued tRNA-like sequences

| Name | Sequence[1] |
|---|---|
| >AT5G46330.1 | SEQ ID NO: 128 |
| >AT5G54110.1 | SEQ ID NO: 129 |
| >AT5G59380.1 | SEQ ID NO: 130 |
| >AT5G65730.1 | SEQ ID NO: 131 |
| >AT3G02020.1 | SEQ ID NO: 132 |
| >AT5G63840.1 | SEQ ID NO: 133 |
| >AT2G36930.1 | SEQ ID NO: 134 |
| >AT5G59950.5 | SEQ ID NO: 135 |
| >AT5G20180.1 | SEQ ID NO: 136 |
| >AT5G20180.2 | SEQ ID NO: 137 |
| >AT1G07940.2 | SEQ ID NO: 138 |
| >AT2G14260.2 | SEQ ID NO: 139 |
| >AT3G05520.2 | SEQ ID NO: 140 |
| >AT4G10840.1 | SEQ ID NO: 141 |
| >AT4G10840.2 | SEQ ID NO: 142 |
| >AT1G73650.3 | SEQ ID NO: 143 |
| >AT2G45990.1 | SEQ ID NO: 144 |
| >AT2G45990.3 | SEQ ID NO: 145 |
| >AT2G45990.4 | SEQ ID NO: 146 |
| >AT3G03160.1 | SEQ ID NO: 147 |
| >AT5G64870.1 | SEQ ID NO: 148 |
| >AT1G13600.1 | SEQ ID NO: 149 |
| >AT1G73177.1 | SEQ ID NO: 150 |
| >AT1G07670.1 | SEQ ID NO: 151 |
| >AT1G55490.1 | SEQ ID NO: 152 |
| >AT1G55490.2 | SEQ ID NO: 153 |
| >AT1G55680.1 | SEQ ID NO: 154 |
| >AT2G14120.1 | SEQ ID NO: 155 |
| >AT2G14120.2 | SEQ ID NO: 156 |
| >AT2G14120.3 | SEQ ID NO: 157 |
| >AT2G32730.1 | SEQ ID NO: 158 |
| >AT3G10760.1 | SEQ ID NO: 159 |
| >AT4G10320.1 | SEQ ID NO: 160 |
| >AT4G16990.4 | SEQ ID NO: 161 |

[1]SEQ ID NO correspond to DNA molecules which encode the corresponding RNA molecules present in certain recombinant RNA molecules provided herein.

TABLE 5

IRES sequences

| IRES name | Sequence[1] |
|---|---|
| ECMV IRES | SEQ ID NO: 162 |
| CrTMV IRES | SEQ ID NO: 163 |
| HCRSV IRES | SEQ ID NO: 164 |
| ZmHSP101 IRES | SEQ ID NO: 165 |

[1]SEQ ID NO correspond to DNA molecules which encode the corresponding RNA molecules present in certain recombinant RNA molecules provided herein.

TABLE 6

Intron sequences

| Intron number | Sequence |
|---|---|
| 1 | SEQ ID NO: 166 |
| 2 | SEQ ID NO: 167 |
| 3 | SEQ ID NO: 168 |
| 4 | SEQ ID NO: 169 |
| 5 | SEQ ID NO: 170 |
| 6 | SEQ ID NO: 171 |
| 7 | SEQ ID NO: 172 |
| 8 | SEQ ID NO: 173 |
| 9 | SEQ ID NO: 174 |
| 10 | SEQ ID NO: 175 |
| 11 | SEQ ID NO: 176 |
| 12 | SEQ ID NO: 177 |
| 13 | SEQ ID NO: 178 |

TABLE 7

Constructs 1-11

| Name | Sequence |
|---|---|
| Construct 1 | SEQ ID NO: 179 |
| Pcambia | SEQ ID NO: 180 |
| p35S | SEQ ID NO: 181 |
| BPEV 5' replication recognition sequence | SEQ ID NO: 182 |
| Firefly luciferase | SEQ ID NO: 183 |
| BPEV 3' replication recognition sequence | SEQ ID NO: 184 |
| t35S | SEQ ID NO: 185 |
| Construct 2 | SEQ ID NO: 186 |
| Pcambia | SEQ ID NO: 187 |
| p35S | SEQ ID NO: 188 |
| BPEV 5' replication recognition sequence | SEQ ID NO: 189 |
| ZmHSP101 IRES | SEQ ID NO: 190 |
| Firefly luciferase | SEQ ID NO: 191 |
| BPEV 3' replication recognition sequence | SEQ ID NO: 192 |
| t35S | SEQ ID NO: 193 |
| Construct 3 | SEQ ID NO: 194 |
| Pcambia | SEQ ID NO: 195 |
| p35S | SEQ ID NO: 196 |
| BPEV 5' replication recognition sequence | SEQ ID NO: 197 |
| Pepper PDS ribozyme | SEQ ID NO: 198 |
| BPEV 3' replication recognition sequence | SEQ ID NO: 199 |
| t35S | SEQ ID NO: 200 |
| Construct 4 | SEQ ID NO: 201 |
| pACYC_backbone | SEQ ID NO: 202 |
| pT7 | SEQ ID NO: 203 |
| BPEV 5' replication recognition sequence | SEQ ID NO: 204 |
| Firefly luciferase | SEQ ID NO: 205 |
| BPEV 3' replication recognition sequence | SEQ ID NO: 206 |
| Construct 5 | SEQ ID NO: 207 |
| pACYC_backbone | SEQ ID NO: 208 |
| pT7 | SEQ ID NO: 209 |
| BPEV 5' replication recognition sequence | SEQ ID NO: 210 |
| Firefly luciferase | SEQ ID NO: 211 |
| ZmHSP101 IRES | SEQ ID NO: 212 |
| TMV MP | SEQ ID NO: 213 |
| BPEV 3' replication recognition sequence | SEQ ID NO: 214 |
| Construct 6 | SEQ ID NO: 215 |
| pACYC_backbone | SEQ ID NO: 216 |
| pT7 | SEQ ID NO: 217 |
| BPEV 5' replication recognition sequence | SEQ ID NO: 218 |
| Firefly luciferase | SEQ ID NO: 219 |
| Isoleucine tRNA | SEQ ID NO: 220 |
| BPEV 3' replication recognition sequence | SEQ ID NO: 221 |
| Construct 7 | SEQ ID NO: 222 |
| pACYC_backbone | SEQ ID NO: 223 |
| pT7 | SEQ ID NO: 224 |
| OsEV 5' replication recognition sequence | SEQ ID NO: 225 |
| Firefly luciferase | SEQ ID NO: 226 |
| Isoleucine tRNA | SEQ ID NO: 227 |
| OsEV 3' replication recognition sequence | SEQ ID NO: 228 |
| Construct 8 | SEQ ID NO: 229 |
| pACYC_backbone | SEQ ID NO: 230 |
| pT7 | SEQ ID NO: 231 |
| Hammerhead ribozyme | SEQ ID NO: 232 |
| BPEV 5' replication recognition sequence | SEQ ID NO: 233 |
| Firefly luciferase | SEQ ID NO: 234 |
| BPEV 3' replication recognition sequence | SEQ ID NO: 235 |
| HDV ribozyme | SEQ ID NO: 236 |
| Construct 9 | SEQ ID NO: 237 |
| pCambia_no_hyg | SEQ ID NO: 238 |
| p35S | SEQ ID NO: 239 |
| TMV CP | SEQ ID NO: 240 |
| t35S | SEQ ID NO: 241 |
| pAtUBQ10 | SEQ ID NO: 242 |
| Hammerhead ribozyme | SEQ ID NO: 243 |
| BPEV 5' replication recognition sequence | SEQ ID NO: 244 |
| Firefly luciferase | SEQ ID NO: 245 |
| ZmHSP101 IRES | SEQ ID NO: 246 |
| PMMo V MP | SEQ ID NO: 247 |
| Isoleucine tRNA | SEQ ID NO: 248 |
| TMV OAS | SEQ ID NO: 249 |
| BPEV 3' replication recognition sequence | SEQ ID NO: 250 |
| HDV ribozyme | SEQ ID NO: 251 |
| tHsp | SEQ ID NO: 252 |
| Construct 10 | SEQ ID NO: 253 |
| pCambia_no_hyg | SEQ ID NO: 254 |

TABLE 7-continued

Constructs 1-11

| Name | Sequence |
|---|---|
| p35S | SEQ ID NO: 255 |
| TMV CP | SEQ ID NO: 256 |
| t35S | SEQ ID NO: 257 |
| pAtUBQ10 | SEQ ID NO: 258 |
| Hammerhead ribozyme | SEQ ID NO: 259 |
| BPEV 5' replication recognition sequence | SEQ ID NO: 260 |
| Firefly luciferase with intron | SEQ ID NO: 261 |
| ZmHSP101 IRES | SEQ ID NO: 262 |
| PMMo V MP | SEQ ID NO: 263 |
| Isoleucine tRNA | SEQ ID NO: 264 |
| TMV OAS | SEQ ID NO: 265 |
| BPEV 3' replication recognition sequence | SEQ ID NO: 266 |
| HDV ribozyme | SEQ ID NO: 267 |
| tHsp | SEQ ID NO: 268 |
| Construct 11 | SEQ ID NO: 269 |
| pACYC_backbone | SEQ ID NO: 270 |
| pT7 | SEQ ID NO: 271 |
| BPEV 5' replication recognition sequence | SEQ ID NO: 272 |
| Firefly luciferase with intron | SEQ ID NO: 273 |
| ZmHSP101 IRES | SEQ ID NO: 274 |
| PMMoV MP | SEQ ID NO: 275 |
| Isoleucine tRNA | SEQ ID NO: 276 |
| TMV OAS | SEQ ID NO: 277 |
| BPEV 3' replication recognition sequence | SEQ ID NO: 278 |

TABLE 8

5' conserved motif 1

| ID | start | end | score | Sequence | Dot-bracket |
|---|---|---|---|---|---|
| NC_028949 | 61 | 94 | 28.6539 | SEQ ID NO: 279 | ((((((((((((((...)))))))))))))) |
| NC_023641 | 54 | 87 | 28.6539 | SEQ ID NO: 280 | ((((((((((((((...)))))))))))))) |
| NC_034216 | 54 | 87 | 28.6539 | SEQ ID NO: 281 | ((((((((((((((...)))))))))))))) |
| NC_027920 | 92 | 125 | 28.3124 | SEQ ID NO: 282 | ((((((((((((((....)))))))))))))) |
| NC_039216 | 92 | 125 | 28.3124 | SEQ ID NO: 283 | ((((((((((((((....)))))))))))))) |
| NC_040825 | 70 | 103 | 28.3124 | SEQ ID NO: 284 | ((((((((((((((....)))))))))))))) |
| NC_038422 | 92 | 125 | 28.3124 | SEQ ID NO: 285 | ((((((((((((((....)))))))))))))) |
| NC_043109 | 58 | 91 | 27.6697 | SEQ ID NO: 286 | ((((((((((((((......)))))))))))))) |
| NC_029064 | 58 | 91 | 26.9303 | SEQ ID NO: 287 | ((((((((((((((.....)))))))))))))) |
| NC_007647 | 95 | 128 | 26.1285 | SEQ ID NO: 288 | .((((((((((((((......)))))))))))))) |

TABLE 9

5' conserved motif 2.

| ID | start | end | score | Sequence | Dot-bracket |
|---|---|---|---|---|---|
| NC_040799 | 451 | 484 | 26.5814 | SEQ ID NO: 289 | ...(((.(((...........))).))...)) |
| NC_023641 | 107 | 140 | 26.2301 | SEQ ID NO: 290 | (.((.((((............)))).)).)))) |
| NC_038422 | 147 | 180 | 26.0438 | SEQ ID NO: 291 | .((((((((...............).)))))). |
| NC_040825 | 177 | 210 | 24.6702 | SEQ ID NO: 292 | .(((((((.............)))))).)) |
| NC_039216 | 464 | 497 | 24.3448 | SEQ ID NO: 293 | )(((.(((.((...............))))...)) |
| NC_007647 | 130 | 163 | 24.2612 | SEQ ID NO: 294 | (((((((((............)))))))))).( |
| NC_007648 | 370 | 403 | 23.5937 | SEQ ID NO: 295 | (((((((((............))))...)).) |
| NC_039217 | 366 | 399 | 22.8964 | SEQ ID NO: 296 | ...((((..............)))))))).)) |
| NC_027920 | 302 | 335 | 22.58 | SEQ ID NO: 297 | ..((((((...............)))))).) |

TABLE 10

| | | | 5' conserved motif 3 | | |
|---|---|---|---|---|---|
| ID | start | end | score | Sequence | Dot-bracket |
| NC_007647 | 54 | 81 | 18.065 | SEQ ID NO: 298 | ((((((((((((....)))))))))))) |
| NC_039216 | 420 | 447 | 18.065 | SEQ ID NO: 299 | ..((((((((((....))..)))))))))) |
| NC_038422 | 55 | 82 | 18.065 | SEQ ID NO: 300 | ))((((((((((....)))))))))))). |
| NC_024455 | 36 | 63 | 18.065 | SEQ ID NO: 301 | ((((((((((((....)))))))))))) |
| NC_007649 | 54 | 81 | 18.065 | SEQ ID NO: 302 | ((((((((((((....)))))))))))) |
| NC_040825 | 324 | 351 | 18.065 | SEQ ID NO: 303 | (((...((((((....)).)))).... |
| NC_016648 | 55 | 82 | 18.065 | SEQ ID NO: 304 | ((((((((((((....)))))))))))) |
| NC_029064 | 381 | 408 | 17.3838 | SEQ ID NO: 305 | ((((((((.((....)).).)))... |
| NC_043109 | 102 | 129 | 17.3672 | SEQ ID NO: 306 | (...(((((.((....)).).)))... |
| NC_023641 | 260 | 287 | 15.4922 | SEQ ID NO: 307 | (.(((((((((....))))).))))) |
| NC_034216 | 108 | 135 | 15.4922 | SEQ ID NO: 308 | .((.(((..((....))..)))).)) |
| NC_028949 | 273 | 300 | 15.4922 | SEQ ID NO: 309 | ((.(((..((((....))))..))).)) |
| NC_040799 | 385 | 412 | 15.0744 | SEQ ID NO: 310 | .(((.((...((....))...)))))) |
| NC_007648 | 76 | 103 | 14.0185 | SEQ ID NO: 311 | ...(.(((((((....))))))).))) |

TABLE 11

| | | | 3' conserved motif 1 | | |
|---|---|---|---|---|---|
| ID | start | end | score | Sequence | Dot-bracket |
| NC_016648 | 33 | 58 | 24.5196 | SEQ ID NO: 312 | ((.(((..............))).) |
| NC_031336 | 56 | 81 | 24.0017 | SEQ ID NO: 313 | .(((((..............))))). |
| NC_043109 | 206 | 231 | 23.8605 | SEQ ID NO: 314 | (((.((..............))))) |
| NC_039216 | 11 | 36 | 23.8447 | SEQ ID NO: 315 | (..(((..............))).. |
| NC_040799 | 433 | 458 | 22.9536 | SEQ ID NO: 316 | ((((((..............)))).) |
| NC_024455 | 435 | 460 | 22.7717 | SEQ ID NO: 317 | ((((((..............)))))) |
| NC_029064 | 56 | 81 | 21.6556 | SEQ ID NO: 318 | (((.(((............))).))) |
| NC_038422 | 131 | 156 | 20.4816 | SEQ ID NO: 319 | ((((((.............)).))) |
| NC_040558 | 375 | 400 | 19.8443 | SEQ ID NO: 320 | .(((((...............)))) |
| NC_007647 | 377 | 402 | 19.6202 | SEQ ID NO: 321 | (((((.................))))) |

TABLE 12

| | | | 3' conserved motif 2 | | |
|---|---|---|---|---|---|
| ID | start | end | score | Sequence | Dot-bracket |
| NC_016648 | 78 | 118 | 21.3334 | SEQ ID NO: 322 | )(((((.....(((.(.(.....)).))))......))))) |
| NC_038422 | 177 | 217 | 20.5634 | SEQ ID NO: 323 | (((.((.....(((.(((.....))))))......)).)) |
| NC_027920 | 360 | 400 | 19.0346 | SEQ ID NO: 324 | .((((((...(((((.(.(.....)).))))..........). |
| NC_043109 | 158 | 198 | 17.9168 | SEQ ID NO: 325 | .(((((.(.................).))))).....)))). |

TABLE 12-continued

3' conserved motif 2

| ID | start | end | score | Sequence | Dot-bracket |
|---|---|---|---|---|---|
| NC_029064 | 342 | 382 | 16.9873 | SEQ ID NO: 326 | (..(((((.....((...........))...))))....))).) |
| NC_007647 | 411 | 451 | 16.8916 | SEQ ID NO: 327 | .((((.......(((((.......)))))).......))))( |
| NC_023641 | 327 | 367 | 16.499 | SEQ ID NO: 328 | ((..(((((((((.(((.......)))).......))))) |
| NC_039216 | 149 | 189 | 14.378 | SEQ ID NO: 329 | (.(((((((..(((.(((.......))))...)..))))) |

TABLE 13

3' conserved motif 3

| ID | start | end | score | Sequence | Dot-bracket |
|---|---|---|---|---|---|
| NC_024455 | 20 | 50 | 19.7807 | SEQ ID NO: 330 | ((...((....(((...))..))...))) |
| NC_039217 | 30 | 60 | 19.5078 | SEQ ID NO: 331 | ((((.(....(((...)))...)).)))) |
| NC_031336 | 259 | 289 | 18.2695 | SEQ ID NO: 332 | (((..(((....(((...))...)))).) |
| NC_040825 | 243 | 273 | 18.2345 | SEQ ID NO: 333 | .(((((((...(((...))...))))))) |
| NC_007648 | 137 | 167 | 17.5665 | SEQ ID NO: 334 | ((.(((.(((.(((...))...)))))). |
| NC_034216 | 117 | 147 | 17.4943 | SEQ ID NO: 335 | ((((.(((((.(((...))...)))).)) |
| NC_028949 | 309 | 339 | 16.5839 | SEQ ID NO: 336 | (...(((....((....))...)))..)) |
| NC_040558 | 37 | 67 | 15.2611 | SEQ ID NO: 337 | ((((.(((...(((......))).)))))) |

TABLE 14

Endornavirus RDRPs

| Name | Coding Sequence | Amino Acid Sequence |
|---|---|---|
| Oryza sativa endornavirus (NC_007647) RDRP | SEQ ID NO: 338 | SEQ ID NO: 355 |
| Vicia faba endornavirus (NC_007648) RDRP | SEQ ID NO: 339 | SEQ ID NO: 356 |
| Oryza rufipogon endornavirus (NC_007649) RDRP | SEQ ID NO: 340 | SEQ ID NO: 357 |
| Persea americana endornavirus (NC_016648) RDRP | SEQ ID NO: 341 | SEQ ID NO: 358 |
| Lagenaria siceraria endornavirus (NC_023641) RDRP | SEQ ID NO: 342 | SEQ ID NO: 359 |
| Yerba mate endornavirus strain INTA (NC_024455) RDRP | SEQ ID NO: 343 | SEQ ID NO: 360 |
| Hot pepper alphaendornavirus (NC_027920) RDRP | SEQ ID NO: 344 | SEQ ID NO: 361 |
| Hordeum vulgare endornavirus (NC_028949) RDRP | SEQ ID NO: 345 | SEQ ID NO: 362 |
| Cucumis melo endornavirus isolate CL-01 (NC_029064) RDRP | SEQ ID NO: 346 | SEQ ID NO: 363 |
| Winged bean alphaendornavirus 1 (NC_031336) RDRP | SEQ ID NO: 347 | SEQ ID NO: 364 |
| Lagenaria siceraria endornavirus Hubei isolate (NC_034216) RDRP | SEQ ID NO: 348 | SEQ ID NO: 365 |
| Phaseolus vulgaris endornavirus 2 isolate PvEV-2 (NC_038422) RDRP | SEQ ID NO: 349 | SEQ ID NO: 366 |
| Bell pepper endornavirus isolate Penol (NC_039216) RDRP | SEQ ID NO: 350; SEQ ID NO: 494 | SEQ ID NO: 367; SEQ ID NO: 539 |
| Phaseolus vulgaris alphaendornavirus 1 isolate PvEV-1 (NC_039217) RDRP | SEQ ID NO: 351 | SEQ ID NO: 368 |
| Phaseolus endornavirus 3 isolate LA (NC_040558) RDRP | SEQ ID NO: 352 | SEQ ID NO: 369 |
| Helianthus annuus alphaendornavirus isolate BJ (NC_040799) RDRP | SEQ ID NO: 353 | SEQ ID NO: 370 |
| Cluster bean endornavirus isolate: 593049 (NC_040825) RDRP | SEQ ID NO: 354 | SEQ ID NO: 371 |
| Bell pepper endornavirus (AB597230) | SEQ ID NO: 489 | SEQ ID NO: 534 |
| Cucumis melo endornavirus isolate CL-01 (NC_029064) RDRP | SEQ ID NO: 490 | SEQ ID NO: 535 |
| Bell pepper endornavirus isolate Maor (KP455654) | SEQ ID NO: 491 | SEQ ID NO: 536 |
| Bell pepper endornavirus (KT149366) | SEQ ID NO: 492 | SEQ ID NO: 537 |
| Bell pepper endornavirus isolate BPEV-YW (JN019858) | SEQ ID NO: 493 | SEQ ID NO: 538 |
| Persea americana endornavirus isolate Fuerte (JN880414) RDRP | SEQ ID NO: 495 | SEQ ID NO: 540 |
| Bell pepper endornavirus isolate lj (KF709944) | SEQ ID NO: 496 | SEQ ID NO: 541 |
| Oryza sativa endornavirus (D32136) RDRP | SEQ ID NO: 497 | SEQ ID NO: 542 |
| Oryza rufipogon endornavirus (AB014344) RDRP | SEQ ID NO: 498 | SEQ ID NO: 543 |
| Cucumber endornavirus 1 isolate CuEV1 (MT586998) RDRP | SEQ ID NO: 499 | SEQ ID NO: 544 |
| Bell pepper endornavirus strain IS (JQ951943) RDRP | SEQ ID NO: 500 | SEQ ID NO: 545 |
| Fagopyrum esculentum endornavirus 2 isolate SK (MZ517186) RDRP | SEQ ID NO: 501 | SEQ ID NO: 546 |

TABLE 14-continued

Endornavirus RDRPs

| Name | Coding Sequence | Amino Acid Sequence |
|---|---|---|
| Capsicum frutescens endornavirus 1 isolate LA-C (MT013202) RDRP | SEQ ID NO: 502 | SEQ ID NO: 547 |
| Cucumis melo alphaendornavirus strain CmEV/BRA/TO-23/2014 (MH365458) RDRP | SEQ ID NO: 503 | SEQ ID NO: 548 |
| Bell pepper alphaendornavirus isolate Antioquia May 5 (MN073197) RDRP | SEQ ID NO: 504 | SEQ ID NO: 549 |
| Capsicum frutescens endornavirus 1 isolate LA-A (MT013200) RDRP | SEQ ID NO: 505 | SEQ ID NO: 550 |
| Capsicum frutescens endornavirus 1 isolate LA-B (MT013201) RDRP | SEQ ID NO: 506 | SEQ ID NO: 551 |
| Plant associated alphaendornavirus 1 isolate BER19SW1 (OL472077) RDRP | SEQ ID NO: 507 | SEQ ID NO: 552 |
| Tomato associated alphaendornavirus 1 isolate BOL20S (OL472079) RDRP | SEQ ID NO: 508 | SEQ ID NO: 553 |
| Bell pepper alphaendornavirus isolate MS1 (MN175323) RDRP | SEQ ID NO: 509 | SEQ ID NO: 554 |
| Brown algae endornavirus 1 Chibal (LC521321) RDRP | SEQ ID NO: 510 | SEQ ID NO: 555 |
| Brown algae endornavirus 2 Chiba2 (LC521322) RDRP | SEQ ID NO: 511 | SEQ ID NO: 556 |
| Bell pepper alphaendornavirus isolate BPEV_Panama (MZ127290) RDRP | SEQ ID NO: 512 | SEQ ID NO: 557 |
| Lily alphaendornavirus isolate BJ (MZ614632) RDRP | SEQ ID NO: 513 | SEQ ID NO: 558 |
| Phaseolus vulgaris alphaendornavirus 2 (OM112199) RDRP | SEQ ID NO: 514 | SEQ ID NO: 559 |
| Basella alba alphaendornavirus strain Oahu4 (OM108480) RDRP | SEQ ID NO: 515 | SEQ ID NO: 560 |
| Pumpkin alphaendornavirus isolate Anhui (MW018478) RDRP | SEQ ID NO: 516 | SEQ ID NO: 561 |
| Oryza sativa alphaendornavirus isolate BXCFS134 (MZ209990) RDRP | SEQ ID NO: 517 | SEQ ID NO: 562 |
| Oryza sativa alphaendornavirus isolate DHCFY127945 (MZ209614) RDRP | SEQ ID NO: 518 | SEQ ID NO: 563 |
| Pterostylis alphaendornavirus strain HR (OL471320) RDRP | SEQ ID NO: 519 | SEQ ID NO: 564 |
| Bell pepper alphaendornavirus isolate LA-E (MT013204) RDRP | SEQ ID NO: 520 | SEQ ID NO: 565 |
| Triticeae associated alphaendornavirus isolate Wheeler (MW091544) RDRP | SEQ ID NO: 521 | SEQ ID NO: 566 |
| Hordeum vulgare alphaendornavirus isolate HYT-37 (MN107382) RDRP | SEQ ID NO: 522 | SEQ ID NO: 567 |
| Hordeum vulgare alphaendornavirus isolate HYT-38 (MN107383) RDRP | SEQ ID NO: 523 | SEQ ID NO: 568 |
| Cucumis melo alphaendornavirus isolate IL (MN398900) RDRP | SEQ ID NO: 524 | SEQ ID NO: 569 |
| Phaseolus vulgaris alphaendornavirus 1 isolate PVAV1/CG6 (MN832719) RDRP | SEQ ID NO: 525 | SEQ ID NO: 570 |
| Phaseolus vulgaris alphaendornavirus 2 isolate PVAV2/CG6 (MN832720) RDRP | SEQ ID NO: 526 | SEQ ID NO: 571 |
| Bell pepper alphaendornavirus isolate XJ (MH182675) RDRP | SEQ ID NO: 527 | SEQ ID NO: 572 |
| Bell pepper alphaendornavirus isolate Marinilla (MK284997) RDRP | SEQ ID NO: 528 | SEQ ID NO: 573 |
| Bell pepper alphaendornavirus isolate San Vicente (MK284998) RDRP | SEQ ID NO: 529 | SEQ ID NO: 574 |
| Bell pepper alphaendornavirus isolate May8A (MK116548) RDRP | SEQ ID NO: 530 | SEQ ID NO: 575 |
| Endornavirus RDRP from Oryza sativa M-102 | SEQ ID NO: 531 | — |
| Johnsongrass virus isolate JVG-1 (MW756210) RDRP | SEQ ID NO: 532 | SEQ ID NO: 576 |
| Johnsongrass virus isolate JVG-2 (MW756211) RDRP | SEQ ID NO: 533 | SEQ ID NO: 577 |
| Consensus endornavirus RdRP partial sequence identified from Oryza sativa cultivars M-102 and Colusa | SEQ ID NO: 455 | SEQ ID NO: 456 |
| Endornavirus RdRP fragment identified from Oryza sativa Colusa | SEQ ID NO: 457 | — |
| Endornavirus RdRP fragment identified from Oryza sativa M102 | SEQ ID NO: 459 | — |
| Endornavirus RdRP identified from Rutgers tomato | SEQ ID NO: 468 | — |
| Endornavirus RdRP identified from Early Girl (F1) tomato | SEQ ID NO: 469 | — |

TABLE 15

Paired Endornavirus 5' and 3' replicase recognition sequences from the same Endornavirus

| Endornavirus | 5' replicase recognition sequence(s) (DNA coding sequence)[1] | 3' replicase recognition sequence(s) (DNA coding sequence)[1] |
|---|---|---|
| Oryza sativa endornavirus >NC_007647 | SEQ ID NO: 2 | SEQ ID NO: 21 |
| Vicia faba endornavirus >NC_007648 | SEQ ID NO: 3 | SEQ ID NO: 22 |
| Oryza rufipogon endornavirus >NC_007649 | SEQ ID NO: 4 | SEQ ID NO: 23 |
| Persea americana endornavirus >NC_016648 | SEQ ID NO: 5 | SEQ ID NO: 24 |
| Lagenaria siceraria endornavirus >NC_023641 | SEQ ID NO: 6 | SEQ ID NO: 25 |

TABLE 15-continued

Paired Endornavirus 5' and 3' replicase recognition sequences from the same Endornavirus

| Endornavirus | 5' replicase recognition sequence(s) (DNA coding sequence)[1] | 3' replicase recognition sequence(s) (DNA coding sequence)[1] |
|---|---|---|
| Yerba mate endornavirus strain INTA >NC_024455 | SEQ ID NO: 7 | SEQ ID NO: 26 |
| Hot pepper alphaendornavirus >NC_027920 | SEQ ID NO: 8 | SEQ ID NO: 27 |
| Hordeum vulgare endornavirus >NC_028949 | SEQ ID NO: 9 | SEQ ID NO: 28 |
| Cucumis melo endornavirus isolate CL-01 >NC_029064 | SEQ ID NO: 10 | SEQ ID NO: 29 |
| Winged bean alphaendornavirus 1 >NC_031336 | SEQ ID NO: 11; SEQ ID NO: 378 | SEQ ID NO: 30; SEQ ID NO: 415 |
| Lagenaria siceraria endornavirus Hubei isolate >NC_034216 | SEQ ID NO: 12; | SEQ ID NO: 31; SEQ ID NO: 452 |
| Phaseolus vulgaris endornavirus 2 isolate PvEV-2 >NC_038422 | SEQ ID NO: 13 | SEQ ID NO: 32 |
| Bell pepper endornavirus isolate Penol >NC_039216 | SEQ ID NO: 14; SEQ ID NO: 376 | SEQ ID NO: 33; SEQ ID NO: 411 |
| Phaseolus vulgaris alphaendornavirus 1 isolate PvEV-1 >NC_039217 | SEQ ID NO: 15 | SEQ ID NO: 34 |
| Phaseolus endornavirus 3 isolate LA >NC_040558 | SEQ ID NO: 16; GGGGAAAT | SEQ ID NO: 35; SEQ ID NO: 412 |
| Helianthus annuus alphaendornavirus isolate BJ >NC_040799 | SEQ ID NO: 17; SEQ ID NO: 404 | SEQ ID NO: 36; SEQ ID NO: 450 |
| Cluster bean endornavirus isolate: 593049 >NC_040825 | SEQ ID NO: 18; SEQ ID NO: 379 | SEQ ID NO: 37; SEQ ID NO: 416 |
| Basella alba endornavirus 1, BaEV1 >NC_043109 | SEQ ID NO: 19 | SEQ ID NO: 38 |
| Bell pepper endornavirus >AB597230 | SEQ ID NO: 372 | SEQ ID NO: 406 |
| Cucumis melo endornavirus isolate CL-01 >NC_029064 | GGTA | SEQ ID NO: 407 |
| Bell pepper endornavirus isolate Maor >KP455654 | SEQ ID NO: 373 | SEQ ID NO: 408 |
| Bell pepper endornavirus >KT149366 | SEQ ID NO: 374 | SEQ ID NO: 409 |
| Bell pepper endornavirus isolate BPEV-YW >JN019858 | SEQ ID NO: 375 | SEQ ID NO: 410 |
| Persea americana endornavirus isolate Fuerte >JN880414 | GTA | SEQ ID NO: 413 |
| Bell pepper endornavirus isolate lj >KF709944 | SEQ ID NO: 377 | SEQ ID NO: 414 |
| Oryza sativa endornavirus >D32136 | TGAA | SEQ ID NO: 417 |

TABLE 15-continued

Paired Endornavirus 5' and 3' replicase recognition sequences from the same Endornavirus

| Endornavirus | 5' replicase recognition sequence(s) (DNA coding sequence)[1] | 3' replicase recognition sequence(s) (DNA coding sequence)[1] |
| --- | --- | --- |
| Oryza rufipogon endornavirus >AB014344 | TGAA | SEQ ID NO: 418 |
| Cucumber endornavirus 1 isolate CuEV1 >MT586998 | SEQ ID NO: 380 | SEQ ID NO: 419 |
| Bell pepper endornavirus strain IS >JQ951943 | SEQ ID NO: 381 | SEQ ID NO: 420 |
| Fagopyrum esculentum endornavirus 2 isolate SK >MZ517186 | SEQ ID NO: 382 | SEQ ID NO: 421 |
| Capsicum frutescens endornavirus 1 isolate LA-C >MT013202 | SEQ ID NO: 383 | SEQ ID NO: 422 |
| Cucumis melo alphaendornavirus strain CmEV/BRA/TO-23/2014 >MH365458 | SEQ ID NO: 384 | SEQ ID NO: 423 |
| Bell pepper alphaendornavirus isolate Antioquia May 5 >MN073197 | SEQ ID NO: 385 | SEQ ID NO: 424 |
| Capsicum frutescens endornavirus 1 isolate LA-A >MT013200 | SEQ ID NO: 386 | SEQ ID NO: 425 |
| Capsicum frutescens endornavirus 1 isolate LA-B >MT013201 | TAAAAAGGT | SEQ ID NO: 426 |
| Plant associated alphaendornavirus 1 isolate BER19SW1 >OL472077 | SEQ ID NO: 387 | SEQ ID NO: 427 |
| Tomato associated alphaendornavirus 1 isolate BOL20S >OL472079 | GTCAAG | SEQ ID NO: 428 |
| Bell pepper alphaendornavirus isolate MS1 >MN175323 | SEQ ID NO: 388 | SEQ ID NO: 429 |
| Brown algae endornavirus 1 Chiba1 >LC521321 | GTCTCAAG | SEQ ID NO: 430 |
| Brown algae endornavirus 2 Chiba2 >LC521322 | ACA | SEQ ID NO: 431 |
| Bell pepper alphaendornavirus isolate BPEV_Panama >MZ127290 | SEQ ID NO: 389 | SEQ ID NO: 432 |
| Lily alphaendornavirus isolate BJ >MZ614632 | SEQ ID NO: 390 | SEQ ID NO: 433 |
| Phaseolus vulgaris alphaendornavirus 2 >OM112199 | SEQ ID NO: 391 | SEQ ID NO: 434 |
| Basella alba alphaendornavirus strain Oahu4 >OM108480 | AAT | SEQ ID NO: 435 |
| Pumpkin alphaendornavirus isolate Anhui >MW018478 | SEQ ID NO: 392 | SEQ ID NO: 436 |

TABLE 15-continued

Paired Endornavirus 5' and 3' replicase recognition sequences from the same Endornavirus

| Endornavirus | 5' replicase recognition sequence(s) (DNA coding sequence)[1] | 3' replicase recognition sequence(s) (DNA coding sequence)[1] |
|---|---|---|
| Oryza sativa alphaendornavirus isolate BXCFS134 >MZ209990 | SEQ ID NO: 393 | SEQ ID NO: 437 |
| Oryza sativa alphaendornavirus isolate DHCFY127945 >MZ209614 | SEQ ID NO: 394 | SEQ ID NO: 438 |
| Pterosty lis alphaendornavirus strain HR >OL471320 | SEQ ID NO: 395 | SEQ ID NO: 439 |
| Bell pepper alphaendornavirus isolate LA-E >MT013204 | SEQ ID NO: 396 | SEQ ID NO: 440 |
| Triticeae associated alphaendornavirus isolate Wheeler >MW091544 | SEQ ID NO: 397 | SEQ ID NO: 441 |
| Hordeum vulgare alphaendornavirus isolate HYT-37 >MN107382 | SEQ ID NO: 398 | SEQ ID NO: 442 |
| Hordeum vulgare alphaendornavirus isolate HYT-38 >MN107383 | SEQ ID NO: 399 | SEQ ID NO: 443 |
| Cucumis melo alphaendornavirus isolate IL >MN398900 | TTCCGTA | SEQ ID NO: 444 |
| Phaseolus vulgaris alphaendornavirus 1 isolate PVAV1/CG6 >MN832719 | SEQ ID NO: 400 | SEQ ID NO: 445 |
| Phaseolus vulgaris alphaendornavirus 2 isolate PVAV2/CG6 >MN832720 | SEQ ID NO: 401 | SEQ ID NO: 446 |
| Bell pepper alphaendornavirus isolate XJ >MH182675 | SEQ ID NO: 402 | SEQ ID NO: 447 |
| Bell pepper alphaendornavirus isolate Marinilla >MK284997 | SEQ ID NO: 403 | SEQ ID NO: 448 |
| Bell pepper alphaendornavirus isolate San Vicente >MK284998 | GGTTTT | SEQ ID NO: 449 |
| Bell pepper alphaendornavirus isolate May8A >MK116548 | SEQ ID NO: 405 | SEQ ID NO: 451 |
| Endornavirus from rice cultivar M-102 | SEQ ID NO: 483 | SEQ ID NO: 486 |
| Johnsongrass virus isolate JVG-1 >MW756210 | SEQ ID NO: 484 | SEQ ID NO: 487 |
| Johnsongrass virus isolate JVG-2 >MW756211 | SEQ ID NO: 485 | SEQ ID NO: 488 |
| Endornavirus from Rutgers tomato | SEQ ID NO: 465 | SEQ ID NO: 467 |

[1]SEQ ID NO correspond to DNA molecules which encode the corresponding RNA molecules present in certain recombinant RNA molecules provided herein.

OTHER EMBODIMENTS

Although the foregoing disclosure has been described in some detail by way of illustration and example for purposes of clarity of understanding, the descriptions and examples should not be construed as limiting the scope of the disclosure. The disclosures of all patent and scientific literature cited herein are expressly incorporated in their entirety by reference.

Other embodiments are within the claims.

SEQUENCE LISTING (581 sequences)

SEQ ID NO: 1 - DNA, 266 bp, synthetic construct
  misc_feature 1..266: note = Synthetic Construct
  source 1..266: mol_type = other DNA
ggaaaaatgttgaactgtttgtttttatcaaacttaattactttttaacaaccttttcaaatacgaacagtagtattaagataagcaatttaacaggaagaggccggcaaattgaacgcctctcctcaacttattaaaaataagaacaaagaagaatgaatataaactgggaagatcgcatattttgatagaagcaataaagtctaatgtaaaaacagaatctagttgcaaaattattcgacaaatctatttacttggtagtggta

SEQ ID NO: 2 - DNA, 500 bp, Oryza sativa alphaendornavirus
  source 1..500: mol_type = other DNA
tgaaatgtcttgtacgaccatttcaaatttatgtaaattgaacgcagcaacaacagggggggggcggagacgcccccccccttttaaaaataaaaatgatcaaatcaagtacgatcttggtttgatcaaatcaaaaacccctgttataaaagggtttttgaaaagaatggacgatatacaacgtccaaacttaggtacaactgcattagatcctttatttggatggttcagattgcctcgtaatgtccattgtaggatgaacaaaaacaaatttattgataattttgataatttatttgaacattataaaggtaaacaatttcataattgcaaagagatcagtatagtatgtgtagaagctatgaggggagagttacaattgaaagagcgacattatggcattgctcaatctttttctccagatgatgaacgattgagcaaatttagcgttaagaatatgtcatttggcttggtgactagattattatatttgatttatg

SEQ ID NO: 3 - DNA, 500 bp, Vicia faba alphaendornavirus
  source 1..500: mol_type = other DNA
agccaaataagttggcctagacaaactagaaagcaaagcaaatgaaaaaattaacagcaacaactaacaaaaaggaatcgccgccggctccagtcggcgacccttttaaaaaaacaaaagactctgtatcattcacgggcgtgaagacagagttttatggagcgaaaacgccctgcagcactggcatttatcacacaacttgttgtgtgccgtgcgaagacattgatatacacgaggtagtcaaggccgcgtcccgagatgatgcacgccactaccaagaacacccaaactctccaagcaaccccgagctggtcaattcttttaacaaaggtttgacgctcgagagctatacagcgagacagaagggcgagcgtaatctgcaccgatttaacagaaatattaacgctctagttaaaaacttacgcacgcagaagaaacaaactgagagaagcagcatatactgcagccccccaagaaaacatctgggaaggcggccacac

SEQ ID NO: 4 - DNA, 500 bp, Oryza rufipogon alphaendornavirus
  source 1..500: mol_type = other DNA
tgaaatgtctgtgatgaccatttcaaaattatgtaatgtgaatgctgcaaccacagggggggggcggagacgcccccccccttttaaaaataaaaacgatcaaatcaagtacaaacttgatttgataaaaccaaaaaccccaaatacaattgggtttttgaaaagaatggacgacataaaacgtccaaatatgggaactacggctttagatcctctattcgggtggttcagattacctcgcaacgtaaattgtagaatgaacaagaacaagtttatcaccgacttcgacaacttatttgagcattacaaaggaaagaaattccatacatgtaaagaagtcagtgtagtttgcgtagaagctatgaggggagagttacaattaaaagagagacactacggtatcgctcaatcattttcaccacaggatgagagattaagcaaattttgtgttaaaaatatgtcatttggtttaattacacgattactatatttaatttatg

SEQ ID NO: 5 - DNA, 500 bp, Persea americana alphaendornavirus 1
  source 1..500: mol_type = other DNA
gtaatgatggccaacctcgttactaatctactcaaaatatgtaagaaacgtttcaggagggggcctcgaaagaggccccctttaacttataaaaagacgagatcggtaggaagaaatcagtatatagatacaccagacaggctgactgcaattgaacaatgcatgagtgctggctgggttaaactgccacgatgttgtacagtagtacagaaccaaaatccatttgtgacttctttaggcaaattgatggagaaatacaaatctcgttttactaagaataatgagttgccaatgatcccggccattcgtggtgagcggtatgctaaagatctacattatggtttagctgactcaaggccagagggcaaattgatggatgataaaattaacttaggcgagctgagtccgttggatgttgctagattgtattacaatgtactaagacttaaaagatgcatagtcaacgtatcaaagttctcaattgcagaactagaagcttt

SEQ ID NO: 6 - DNA, 500 bp, Lagenaria siceraria alphaendornavirus
  source 1..500: mol_type = other DNA
gtaatggcgttctccattactcgaattaatccatcttatagtctgcaagtaaacggggagagacctccattttggaggtctttcctcaaaaaaataaaatataaggagcaaatgcagtataaaacagatgcaattactccttatagacaaaaatataaagatcggccactacaaactctgaacaaagaggtgtcaagtcacctgcagggttggattagattaccaagaaaccaatccgtcacgataaacaaaaacccttggattagaagttttgaaaaactatttaaacataagcccgatcaaatttttgacaaaaataaaatgaaattggtacctgcaataagaggtgaaaggaaaattagagacacagtcggcacagtcgccacaaatgtaacctatgatgatggactcggtaacgtgatcaatttcaatgaactgcacccattagatgtggtgaagatactttacaacgttaattgtcttggaatcgaattgtggaa

SEQ ID NO: 7 - DNA, 500 bp, Yerba mate alphaendornavirus
  source 1..500: mol_type = other DNA
ttacaattcctaacaaaattaaacaagcaattgtaagagggggcactcgaaagggtgcctcctcatttaaactaaaaccaaagatcaatgattatgcggtggctagatctcttggaagcaagaatagccactgcaaaaatagactcaacatgagaagaggaaaaatattgaacccatccacggagatcaagaacaatctgtatggttggtgtcaattgccaagaaattataaggtaacaattaataataacaaatttatagagaacttagaaggtatttttaagactggccatcaagatgtggatggagacgtactttatatggtaccagcagtaagagggatgctaattccaaaacataaacattatggaatagctagttgtgcaaacacaaaagacgtgatgttcaataagttcgacatggcagatttgagccctttaaacgtgagtaaattatattacaatgtcgtgtgccttggtaatgaattgagaaaattaaac

SEQ ID NO: 8 - DNA, 500 bp, Hot pepper alphaendornavirus
  source 1..500: mol_type = other DNA
gtaaaacaactaaggttttatgactactaagttgtctagaccttttgctttacagttattgggtggctctcgcctcccgaaaactcaaactcttcatgggtgtactggaaacagtatacccatgaagaaaataaataagaaaaacgattgctccgccagaaaagcattcaggcggagtaaatttaaatttaaaataagtaaacaaaagactatatgtcccgcagttatggcacataggttggaagaagagttggaattcgtacaatttggaccagaagagtgtgttcctgatttgaataaagtggacattagaacaattagaaatatgatgttattgttcgaacaagaacattgccacgttgacgtaactgaggaagacgttaaaaagtatttacagcaaagtcaattgcaaagcactgaaccattttatggtggtcccagtaaaatgtattatgcaaattgtaggccaatgctattaccaccctcaaagatagatggta

SEQ ID NO: 9 - DNA, 500 bp, Hordeum vulgare alphaendornavirus
  source 1..500: mol_type = other DNA
gtcaaccaaccatgtacaaccgaacagtacatgagacaggcaattcgtcaccaaaacaaaaagaggtcgagtggcttaaagccactcgacctctaaaaagagacgtgaataaacgatggaaggcaaagctgggaaaaccaaaattgcgacaaaaaccattaagattgaagcgtctcaaagggcaagtggtgaaccgatccaacaacatgaacagccaatacgacaacatgaaaaattattacaatcaaatgacaaaagtacgcatattaggtagaaccatggtaccctgtgcattggctttgcaatttcccatgtccgaaccattggtcaacaattacatggaagcaagttacattgccacatataaactgatgtacaaaaacaaagaaagttacgaagggttgcacccgcatgaactggctgcatttataaaaggtgttagattaaatgtggaagacagtttcaaccatgctggtaacaaattattctatgactctgtc

SEQ ID NO: 10 - DNA, 500 bp, Cucumis melo alphaendornavirus
  source 1..500: mol_type = other DNA
ggtaatggcttcattccccattacgtgtagtaatcctagtactttgtataccgtttcgagggagagacctcctttttggaggtctctccttaagaaactaaaactaaagatgaaatataaagattataaacccattaaaaaggtagtaaagccttctgtagtaaagagagaattttctaacaaactacaggggtggatcaaattacctagaaattgtagaatgggtttaaacaaaaatccgtttcaaaccagttttagaaaagtgtttaaagagaataagtcattaatatttgataaaaataaaattaaattagtaccagcaatccgtggagtcaaaaaatttagagatacttgtgggtcagtggcagccaacatacgcttcgaagaccctcttgctggcgtggttaacttcgaagctatgcacccattagatatagctagaatctattacaacgtgataagtggagggtgtgaaatatggaagccaccacataaaccaa

SEQ ID NO: 11 - DNA, 500 bp, Winged bean alphaendornavirus 1
  source 1..500: mol_type = other DNA
gacatttttaaaaatgcctaaggtctgcagcttgtacaaagcagtacacagcaaactgcaaccaatgggcggttcacgcccacacacacttcgccaagggagaagccttactcccttgtcgaagcaagagaaacacaagactagctattcactgaggaagatctttagaaatagccaagttaaaataaaattaggcgaaaacaaacaaatcgtaccatgcaccatggcctgtagaaaagatgaacacagagaatttatccaatttgggcctgagtgcttggtacctgatttaaatcacatagatactgccacaatgcgaaatttcatcttattatatcaagaaggagtctgtcacatcgcggccaataagttgacgaacaagatggtagccagaaattcccatcttcaaaatgaagaaccgttctggggaccaaatatgagagattattattccaacaaattgccagatgacatttgtccatttaaagaagatgcaaata

SEQ ID NO: 12 - DNA, 500 bp, Lagenaria siceraria alphaendornavirus
  source 1..500: mol_type = other DNA
gtaatggcgttctccattactcgaattacaccatcttatagtctgcaagttaacggggagagacctccattttggaggtctctcctcaaaaaattaaaatataaggagcaaatgcaaatgaatacagatgcaattactccttataaaagaaaatataaagacaaacctcttagacttttaaataaagaattttcaaatcatctgcaagggtggatcaagttgccgagaaatcaatcggtgactattaataagaacccgtggatcaaaagctttcaaaaattatttaaggataaacgtgaacacatatttgataacaacaagttgaaattagttcctgcgattagaggtgaaagaaaaatacgagataccgtaggtactgtggccacaaatgttacttatgatgatggtttaggaaatgttataaatttcaatgaattgcacccgatggatgtggttaaaattttatacaatgtcaattgtctcgggattgaattatggaa

SEQ ID NO: 13 - DNA, 500 bp, Phaseolus vulgaris alphaendornavirus 2
  source 1..500: mol_type = other DNA
ataatttgattgtcgtccaatggctagaaaacttgacaaggtctcgtttttaaagtctttgggtggttcacaccacccgaaaattcaagcttctcatgagcacacgagcaatcgtgtgctcatgagaaaattaaataaaagaaatgaatgctctgcaagaaacgtatacagacagagcaattataaagtaaaactacactcaagcaagaccgttgtgccagcggttatggcagccagacaaggggaagaattagaattcttggaatttggttacgaagaatgtgtgccggacctcaacaaaatagacatacgcacaattcgatctatgatgcaattatttgaacaaggacattgccacatagatatcacaccggaggaagttcaggcaacgttacacaattgtcaactacaaagcacagaaccgtattatggtgcccctggaaaactgtattacaagcattgtcggcctttgttaactccaagatccaaagaagacggaa

SEQ ID NO: 14 - DNA, 500 bp, Bell pepper alphaendornavirus
  source 1..500: mol_type = other DNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgatggcacacagactcgaagaggaattagagttcatacaatttggacctgaagagtgtgttccagatttaaacaaagtggacatcagaaccatcagaaacatgatgctgttgtttgaccaagaccattgtcatttggacgtgaccactgaggatgttgtcaaatacctacaacaaagtcaattgcaaagcacagaaccgttttacggtggacctagtaaaatgtactatgccaattgcaggccgatgttactaccaccatcaaaacaagacggca

SEQ ID NO: 15 - DNA, 500 bp, Phaseolus vulgaris alphaendornavirus 1
  source 1..500: mol_type = other DNA
attggattaatatattggctgtggtaacctaatttaagtactttgttaactactttgcgtctagcatctccgtatgtaatggctccaaagtttattacatgtcttaactcaaataaccaggcaaaactaacgggacctcgaaagaggtcccaaattttaaaatctagtaatggctccaaagtttattacatgtcttaactcaaataaccaggcaaaactaacgggacctcgaaagaggtcccaaattttaaaatctaaacgaagaaaacatacatacggagatgctagacgcaaagtagttaacaaagtacttaaattaggttaccacagccaatatattaatccaataccacaacccaaacaaaccaagccttctatcaagcaattaggttgggtaggattaagtaaaaatagacagattaaacagaacgcgaacccttacgttagatcaataagaaaattgttcaggtcccataaaagacaattaatagatgagaaca

SEQ ID NO: 16 - DNA, 500 bp, Phaseolus vulgaris alphaendornavirus 3
  source 1..500: mol_type = other DNA
ggggaaatatggcaaatttgcttaattccaaacttaatttttcttcaacaaatatgtttaaacatgcaaaaaaggtactcttagaccttgagtcgggagtaccaagagaaagaaaattaatgaaaggaggtgacaaactgataatagacgcgtctaagagcccagtcacgattgggctggcgcgtcaaatgcttaaaaacaagaaaagaaagggaggaatattaactagtaaggttcctgtcttcaagccttccgagaggaaggagatactgaaagcagtaaccgatatgaacatcattacggtcgatggttgcaaagttatacctctcaccccgtcaataggtatgggtgagttcttatcaatcacgtatgatggattagcatgggattgtgcaaacgctttcggactaaacctatttatgcttggggtgttacagggtggacgcgtgctgggccccaaggggatcaaggcagagtcctttaaatcttcataccgggca

SEQ ID NO: 17 - DNA, 500 bp, Helianthus annuus alphaendornavirus
  source 1..500: mol_type = other DNA
acctattgactaatagggacatggacatattaaagaaagaacccaaaccaaaaggggaaccctcttcaatacaacacgctggggatggtccccccagcgtgttaaacgttggcgagatactcgccaacataaacaaactggtgagcgctagggaccgacgccgccagacattaaggaccaaaacacgacgcttgaccgagaacaacgagttcaacgttaaggtcgacccacatttccaaccaaagtttgtgaaatgtgtggcaggttccaacaaacaaagtatgaagaaatcacctcacaagtggcaacacaatgtgatggtatttaacacaataaacctagggaaaagggatcctcatgagattgccaacaagctactggcctacggtgccccagcgaaagtcaaggactgccagtgtgcgagctgcgtgtcagtagataaccaacggtccaaagtagccatcaacacccaggccactctaggcatgtggagcataacc

SEQ ID NO: 18 - DNA, 500 bp, Cluster bean alphaendornavirus 1
  source 1..500: mol_type = other DNA
ataaagacccgcagcccaatggttttatcagccacgtcgacgacaatctgttcaaatacatgcacccttcaacttaggtgtgtgcgaaagcacacacctaagttatataaaaatgaatatcagaagaaggatcaaaccatgaagaagatggtaaaaaggtgtgacgtcaaagatgagaccaaggtaaaattacatgatgatcttgagacttattttaacacaagcaagcaaataaccaggaatgggatgaaaatggtagtttgctgcaccccaatacagttcgtgtttgatgatcctttgttgtccagcgcgttgcaaccagatttcattgccacttggtggctggccaaggaacaagggatgcaaaattatggattaacccctgaacaattcaagccctttgtggacacggctggtttaagtgtggaagatccagctaacaacttgacacacaagtactattatgaacataagaaagacggtgttgagtgtgtttctgt

SEQ ID NO: 19 - DNA, 500 bp, Basella alba alphaendornavirus 1
  source 1..500: mol_type = other DNA
ggaatatggctaatcggcttattctaatcaaacgcaaaagacttatgacacagaccggacctgaacgaggtgataaaacacctcgttcaggttcaaaacgtagaagattcattcctccgattagaaatacaactacgtctaagcacgatagagatggtatcaagatcggttttagaccacgagaaaatcggcaaatgaaagtacaagttgggtggtttaaattaccaagaacagtaacattcaagaacaacggcaacccgtttgttacctcatttcgtaaattgtttagaagtaacaaagataaattatttaatggtgggaagaacctaagtacagtaccagccagaagtagtgaaatgacagaaatgtttatgttcatgtccacgctagagggccaattgtcaatccaagatctagatccaaaaataatcaataagtctatatacatgatagaggtaatgggttacggggtggtcaagcctgacggagttccattctca

SEQ ID NO: 20 - DNA, 51 bp, synthetic construct
  misc_feature 1..51: note = Synthetic Construct
  source 1..51: mol_type = other DNA
gaggttctatcaatttttttttgaaggtaaggatcccaccccccccccccc

SEQ ID NO: 21 - DNA, 500 bp, Oryza sativa alphaendornavirus
  source 1..500: mol_type = other DNA
ccaggatatagcttgtaaatttaatatgcaaagtaaagattcttggatgaccaatggagcaacattctgtagcatggtagtttacaaaacgaatgataatgtagtagaattgggcccagatgtagtcaggatgaaatttaggtatgaagtcaccaatggtgtacacgaagcaactaaagagaacttaatgatgcgcaaggcatcttacttgatgatgttagggaaaacacctgaagttgataaattagtaaatgatctccaattacccatcaatcccgtacactggtacaattatcacacgatgttacagggcgttgctgacaaatgggacatgaacatacaacaagttgaggggtattatcataacttgatctacatgatatctaaagacgacatttatcaacataactttagaggattcggtaatagatgaatattataactaactctgttttgtcaatttatttttaaaaggatggggcacccctcccaaaccccgg

SEQ ID NO: 22 - DNA, 500 bp, Vicia faba alphaendornavirus
  source 1..500: mol_type = other DNA
gcagagtggtcaaggttggacggagtgcaggtgcacgatctatctaagattgacacttccggcaacctagccgaggcactagagggcattggagcttcaatgggcatgccaaaccccatgatggcagccggaatgtcctacctacacatgctaggcaaaagtgaggaagcagacaaaattaacaccgagaaagagtttggcttagaattaagaaaatggtacgacgtggcaagctgcaagaatgccacgtgcatcaaatataacatgtcacccatggaactggaagacaatataggagagctactaaaaatgatcagaaaaccaatggcatatcacaaaaggttcttaaccacagcagcctacagcgcgcaaaaaatcagatgacatggttcaatggataaaaagatagttagttgttgcccccaatcatgaattggaggcaaacacaaggcagaattatcgtgtggcaaccaaaagaactgtgagcccataccatcggg

SEQ ID NO: 23 - DNA, 500 bp, Oryza rufipogon alphaendornavirus
  source 1..500: mol_type = other DNA
caaacacacaacatttacgccaggacatagcttgcaaatttaatatgcaaagcaaggactcatgggtactcaatggggctactttttgtagtatggtagtttacaaaacaaatgatgacgtagttgaaattggtcctgatgtagtcaggatgaaattcaggtttgaagttactaatggtgtgcatgaagcaacgaaagaaaacttattaatgcggaaagcttcatatttgatgatgttagggaaaacaccagaagtggatcaactggtgaaggaattacaactacccataactccaatacattggtacaattatcatatgatgttgcaaggcgttgctgataaatggggtatgaatgtgcaacaagtggaagggtattatcacaatctacttcacatgatatcgagagaaaacatatatattcacagcttcagaggctttggcaatcgttgaacatgattaattatttttaaaagggcggggatccctccccaaccccgg

SEQ ID NO: 24 - DNA, 500 bp, Persea americana alphaendornavirus 1
  source 1..500: mol_type = other DNA
gttcagcgagaaaccatcaatcaaaaatttacgtaatgatatagcctgtgaattcaatatgcaaagtaaggatgaatggagctacaacggtgcaactttttgtagcatgatactagctaaaacgtcggacacaacagcagaggtagcggctgacgtggtacgactgaaattcaggtatgaagtaacaaacggagcgcatgaaatgaacaaagaaaatgtagcaatgcgaaaccaatcgtatttgatgatgataggtgacatgccaaagacaagagatataattatgaaacatggttatgttatcaaaccagtacaatggtacggctacgatacaatgttagcagcggtagctgaaaagtataatatgacccatatccaagtggagggttacctacacaatttattggaaatgatagataaatcgagagtgtacagtcataaatttagagtgtttagcaacaaaccgtaattacgaagttaaagaggcccccccccccccc

SEQ ID NO: 25 - DNA, 500 bp, Lagenaria siceraria alphaendornavirus
  source 1..500: mol_type = other DNA
gaacttaaggaaaaatatcgcaactaaattcaacatgcaaagtaaagacgcatggtacagaaacggagcaacgttctgtagtatggtcatgagtcgcacaccaacaggtgcagagctatgccctgatgtggtcagactcaagtttagatatgaagtaaccaacggagtgcatgaggcgaacgcagaaaacatccttatgagaaaggcctcttacataatgatgttaggtgagggtccaaacgtaaaggagacagtcacaaggttaaatttgccaattaaaccattaatttggtacgattttgagtccatgttgcgagcagttggagacaaatatgatatgacgcacgtacaagtgctagatgtatattataatctgttacagatgattaattcggaaaagctgtataggcatacattcagacatttttcgaacatagaagcaaaataatggaaaataaataattttttgaggaaggtgttttaaaacccccccccccccc

SEQ ID NO: 26 - DNA, 500 bp, Yerba mate alphaendornavirus
  source 1..500: mol_type = other DNA
ttaaggaaggatattgcaacgaaattcaatatgcaaagcaaagataattggtgtaataacggggcgacattttgcagcatggtattatgtaaactgccaaatgacagggctgaattagctgcagatgtagtcaggcttaagcataggtatgaagttactaacggggctcatgaaagtacagcagaaaatttattaatgcgaaaggcatcatacttaatgatgctgggtgatataccaggtgtaaaggaagtggtcagtaatttaaacttaccggttaaaccaatagtatggtacgggtatgacactatgctacaagctgtggcagacaaatacgacatgacgaccgtacaagtggagggttattaccacaacttattagacatgatgagaaaagattataagaggagtataaaatacagattgtttgggaatcaatgaatcggaacataaaggagattcaagaaaatttagtttaaatgaggagatttcaatgaaacggc

SEQ ID NO: 27 - DNA, 500 bp, Hot pepper alphaendornavirus
  source 1..500: mol_type = other DNA
taagctaaacaatgaaacgaaaataaaacacaatatgatgtgcaaaccacatgtaagtaacactcacggtacattttgctgtatgatagcttgtattacacaagaaggaaattgctcattgggtccggacgtagtcaggttaagaagaagatttgaatgcccaaatggagtgagcgaaataacatcagacaatgctttggctagggcgatgtcttactacatgatgttgggagctactccagaagtgatgggagagattaaaactcagaatttacctatacagccaatgcggtggtatgatgtggatagtattagatcagctgtggctgataaatacaatatgagtgatgagcaagtgttgaatgaagaacggcaactattaaagatgttaagagagaggatttattataaacatgaagttctgcattggtttgaaggaatgtgaaaggtactaaccaaaattagtttgagttttcgggaggggagggcccccccccccc

SEQ ID NO: 28 - DNA, 500 bp, Hordeum vulgare alphaendornavirus
  source 1..500: mol_type = other DNA
caaacaaggaggtaaaaacccacggaaaattgttgtataacatgataatgaaacccaatacacacaataatgtcggcacattttgctgtttcaacatatacaagttgcccacaaaccgatggaccatgggccccgacattgcaagactgcgaagacggtttgaagtaactaacggggcgtcagaggccacccttgtcaatcatcacgcaaggtgcatgtcatattgttgtatgttaggatcaatattacccattcaacaattaatcaaggagaggggttacaccgtagagccaccaatgtggtatgattggaactccaacgcaagagccacagaggacaagtaccactggctaccagggaaaagtgacacagagctgcgcatgctgctggatatgatgagacaaacaaactacatcgatcataaactgttgcactgggtagaagcaacccgctagtgctcctacccacgttttggtgacgaacaagattgcccccccccc

SEQ ID NO: 29 - DNA, 500 bp, Cucumis melo alphaendornavirus
  source 1..500: mol_type = other DNA
ttcagtgagaagccagatacgtcaaatctcagaaaagatattgcaaccagcttcaacatgcaaagcaaagattcttgggtgataaatggagctactttttgcagtatggtaatgactagaactaactttggagccgaattagcaccagacgttgtgagacttaagttcagatatgaagtaccaaatggagtgcatgaggctacaccaaccaatgtactaatgagaaaagcttcgtatctaatgatgttgggtaaaggtcctaacgttgacgatacggttaggatgttaaacttacctatcaaaccaatagcatggtacaatttcgatcacatggtgaccgctgtggctcataagtataatatgaacgaggagcaggttagaggttattatgatcaattgttagccacaatcagaagtgacaacatttattcacatgtatttagacatttctctaataaatagtttcttaaggagaggaaaaatcctctctcccccccccc

SEQ ID NO: 30 - DNA, 500 bp, Winged bean alphaendornavirus 1
  source 1..500: mol_type = other DNA
tggtgaataccgactcgttgaatcgggagttgaaggttcaccacaatatgatgtgcaagccaaaactaagtagcgtggttggaacattttgttgtatgattgttgggaaaaatcacttaggtggagcaacactgggcccagactttgttcgattgagacgtagatttgaagtcacaaatggagtcagtgaagcaaatgacgacaacttaagagcgagaagtatgagttatttgatgttcttaggcgatatacctgaagtgcgagaaacagttgcaaacaaaaaattcagcatagagccacttaaatggtatgattacgactctgcagtctacgcaacggcatccaaatacgccattagtgagaccgaagtagaaaacaataagttacaattattagcaatgataaacaatccaatcacataccaaacagacgtgttgcattggtatgaaggtaaataagtgtttctcaagtgtgtgtgtggggtaaggaccccccccccc

SEQ ID NO: 31 - DNA, 500 bp, Lagenaria siceraria alphaendornavirus
  source 1..500: mol_type = other DNA
aatctaaggaaaaatatagcaactaagttcaacatgcaaagcaaagatgcatggtatcgaaatggagcaacattttgcagcatggtcatgagtcgcacaccaacaggcgctgagctatgtccagatgtggttagacttaaatttagatacgaagtgaccaatggagtgcatgaggcaaatgctgagaacattcttatgcgaaaagcgtcttacatcatgatgttaggtgaaggcccaaatgtgaaggagacggtcacaaaattgaacttgccgattaaaccattagtctggtatgactttgaatccatgttaagggcggttggagacaaatatgacatgtctcatgtgcaggtgttagatgtgtattataacttactacaaatgctaaattccgagaagttgtataggcacacatttagacatttttccaacatagaaggaaagtaatggaaggaaggataattttttgaggaaggtgtatagaacaccccccccccccc

SEQ ID NO: 32 - DNA, 500 bp, Phaseolus vulgaris alphaendornavirus 2
  source 1..500: mol_type = other DNA
acaacatgggtggataccactaagttgaataacgagctgaaaaccaaccataacatgatgtgcaaaccaagtttaagtcagactcatggtgtgttttgctgcatgatggcagcaataactgatgaaggtaattgcacactgggaccagatgtggtgcgattaagacgcagattcgagtgtccaaatggggtgagtgaaatgactcccgacaatgtacaagcgagatgcatggcgtattacatgatgctcggggctacacctgaagtgacacgagcaatacagcaacaacagttgcccatacaaccaattaaatggtatgatgcggacagtatacgtagtgcaaccatgagtaaatacaacatggatgccaaccaagttttgaacgaagagagattgttgctaggcatgttaagtgaacccaacagctttgcacacaaaatactacattggcacgaaggtcaatagcttgaattttcggggggtgggggcccccccccccc

SEQ ID NO: 33 - DNA, 500 bp, Bell pepper alphaendornavirus
  source 1..500: mol_type = other DNA
gagcatagatctcagtcgactaaacaatgagacaaagatcaaacacaatatgatgtgtaaaccacacgttagcaacacatacggagtgttttgttgcatgatcgcatgcataacacaacaaggtaattgctcactgggtccagatgtagtgcgcttacgacggcggttcgaatgccccaatggggtaagtgaaaccacatctgaaaatgcattagctagagcaatgtcatattacatgatgctgggtgcaactccagaagttatgaatgaagtaaaggttcagaatttgccaattcaaccggtcaaatggtatgacgtggatagcataaggtcagcagtcgctgagaaatataacatgagcgatgaagaggtcataaacgaagagcggcagcttttaaaaatgttaagagaaaggcagtactttaagcacgaagtgcttcactggtttgaaggaatttaaagccaggttaacaacaaaatttgagttttcggggagggag

SEQ ID NO: 34 - DNA, 500 bp, Phaseolus vulgaris alphaendornavirus 1
  source 1..500: mol_type = other DNA
ttaccaccatttgaagaatgacatcgcaaccatgtttaatatgcaaagcaaagaatcatggaatagcaactatgggactttttgtagtatgctatgtactaaattgccacaatgcaaagccgaaatgtgtcccgacttcgtgcgattgaaatttaggtatgaggtgactaatggagtgcatgaatgtaccaataataatatcatcatgaggaaagctagttatctaatgatgttaggtgatttacctgaagtccgaaacttgatcagagagctagaattgcctattaagcctgtcaaatggtataattatcattgtgccctaaccgcagctggacacaaatatgacatgcacccagaccaagttgaaggtaccttacatcaattactgcacttaatcaaagaagggaaattgcacaagtacacgtttagattatttgaaagtgggaagcatcattaacaatgatgcgataacatgaacccgaacggttcccccccccccc

SEQ ID NO: 35 - DNA, 500 bp, Phaseolus vulgaris alphaendornavirus 3
  source 1..500: mol_type = other DNA
tctgaccgactttgcgtagtacccaacgtcccgcgattggcatataagtgggaagtaccgaatggccagcatgagacgactgaggatgcagtcttcaccagacaactaagctactcttgcattttgggttctaacgaatttagtaaaagagtggagaaattgataaaagataaactaggaggggaattgcaagttccttcttattatgacggcagtgaaatgattcaactaaattgcaagtatcacaaattggaagagatggaagtcgtggaatgcttgaatacgctttatcagagaatagaaaaaccgaccacgaggcaagttacggctctgataactagtgagaacataagaaagggcgtcaaatcaatgagcagaatcaaggagctaacaggagattcggaccaatttgaacacaggagactaatagacgactagctaatcgatgcactccaaattaaagtacaccaagaaatcaactttctcgccccccccccccc

SEQ ID NO: 36 - DNA, 500 bp, Helianthus annuus alphaendornavirus
  source 1..500: mol_type = other DNA
taagcagaaaccgaatcgatagctcgaagcagtcaaaaataagcaaagattattacaacatggtcagcaaggccagtcacgatagagaccaaggaacattccttcaattattatgttaccacaacccacaaggagtactggagtttggcccagacgtaatcagactagcacaaaggtacgaggtgacaaatggagtaagtgagtcgaacaatcacaacatgttggctagaacgatgagctactgtatgttgatagggaaaacaatgggaaccaaggctgtggtgaccaagcatgggttaccaatagatttaaaaaccacctgcagcatggcctcagctagaagagcttgtgcgattaaaaggaagatgactcttggagaggtggagagttacgagagttatttatacagaatgatgaaagacctcaaaacacacacctggatttttaaacacctagcgtgagactgcaagtagagaattggagagggatttccccccccc

SEQ ID NO: 37 - DNA, 500 bp, Cluster bean alphaendornavirus 1
  source 1..500: mol_type = other DNA
cggaatattgatgagtgacaggaaattggatgcagaggacctaaagacatatgggaagaagtactgtaacatgattttgaagcctaaagtgtcaaaaaatagtgcaacattttgttgcttcacgatttatcggactagaagaggcaactttgcactagggcccgacccaatacggttgaaacggaggttcgaggtgacgaacggcgtcagccagatgaccaaacaaaacgttgaggcccgtacgatgtcttattgcatgatgttaggagacataaaagagacatccaacgttattaacaagctgtcattgccaatcaaaccagtcaagtggtacgacgttcaggagtgttttaaagcgagcgatgaaaagcacggtgagtacatgggttgcagcgaagattgtgtgtcccagttgtgtaacatgatgattaacccagttttatatgagtacaccatgactcactggagtgagtcacagtgagaagaagggtgcccccccc

SEQ ID NO: 38 - DNA, 500 bp, Basella alba alphaendornavirus 1
  source 1..500: mol_type = other DNA
atttgaagtataatatagctgtaaattataatatgcaatctaaagaatcctggaacgaagcatttggaaatttctgttccatgcttttatcccccttaacaaataaaagatgtgaattatgtcctgacgtggttagactaaaattccgatacgaggtaacaaatggggtacacgagatgaacgatttgaataacttgatgaggaaagcctcctatattatgatgctggggcaaactccttggaccaaggaaatcgtaaaggatttagacctaccaatacaacctgtagagtggtacagttatgaagacatgattaaaaccgtgggagctaagtatgaaatgaacgaataccaagtagaaggatatttgcacaacttgttgaacctgttaaaatctaaagaatattattcacacaagttccgcatgttcagcaataggacaggtacaaaactatactaacgttttgatagaggttataaacccctaccgggcccccccccc

SEQ ID NO: 39 - DNA, 134 bp, Tobacco mosaic virus
  source 1..134: mol_type = other DNA
taggtttgagagagaagattacaaacgtgagagacggagggcccatggaacttacagaagaagtcgttgatgagttcatggaagatgtccctatgtcgatcaggcttgcaaagtttcgatctcgaaccggaaaa

SEQ ID NO: 40 - DNA, 198 bp, Tobacco mild green mosaic virus
  source 1..198: mol_type = other DNA
aaggtttgagggaacgtattttgagtgtgacagacggctcgccaattgaactcactgaaaaggttgttgaggagttcgtggatgaagtaccaatggctgtgaaactcgaaaaggttccggaaaacaaaaaagaaatggtaggtaataatgttaataataagaaaataaataacagtggtaagaagggttttaaaattg

SEQ ID NO: 41 - DNA, 133 bp, Tomato mosaic virus
  source 1..133: mol_type = other DNA
tgggtttgagggagaaagtaacgagtgtgaacgatggaggacccatggaactttcagaagaagttgttgatgagttcatggagaatgttccaatgtcggttagactcgcaaagtttcgaaccaaatcctcaaa

SEQ ID NO: 42 - DNA, 134 bp, Pepper mild mottle virus
  source 1..134: mol_type = other DNA
taggcttgagagagaaaattactagtgtgtcagaaggaggacccgttgaacttacagaagcagtcgttgatgagttcatcgaatcagttccaatggctgacagattacgtaaatttcgcaatcaatctaagaaa

SEQ ID NO: 43 - DNA, 139 bp, Paprika mild mottle virus
  source 1..139: mol_type = other DNA
aaggtttacgagagaaagtgactacagtgtcagaggacagcgctattgaacttacagaggaagttgttgatgagttcatagaggcagtaccgatggcacgtcggttgcaaaatttcaggaaacccaaaaataatattag

SEQ ID NO: 44 - DNA, 134 bp, Bell pepper mottle virus
  source 1..134: mol_type = other DNA
tgggtttgagggagaagattacaagagtaaccgacgccgggcctatggaacttactgaagaagttgttgatgagttcatagagaatgtcccgatggcggcaaggcttgcaagatttcgaaccaaatcctcaaaa

SEQ ID NO: 45 - DNA, 138 bp, Tomato mottle mosaic virus
  source 1..138: mol_type = other DNA
tgggtttgagggagaagattacaagagtggatgacgcaggtcccattgaacttaccgaagaagttgttgatgagttcatggagagtgtgcctatgtcagtcaggcttgctaaatttcgaaccaaatcctcaaaaagag

SEQ ID NO: 46 - DNA, 135 bp, Odontoglossum ringspot virus
  source 1..135: mol_type = other DNA
tcggactgagagagaagattttgaacgtaacagaaggagggcccaccgaacttactgaagcagttgttgatagattcgtggagaaagttcctatggctgctaggctcaagtcttttcgctctgtcaacaaaaaga

SEQ ID NO: 47 - DNA, 201 bp, Obuda pepper virus
  source 1..201: mol_type = other DNA
agggtctaagagagaaggtgactgccgtgtccgaagacgacgctatagaactcacagaagaggttgttgatgagtttatagaagccgtaccgatggcgcgacgtttgcagaacttgagaaaacccaagtacaacaaagaaaaagaaaataaaaatttgaataataaaaatagtataggagtttccaaacctgtcggtttag

SEQ ID NO: 48 - DNA, 136 bp, Rehmannia mosaic virus
  source 1..136: mol_type = other DNA
tgggtttgagggagaaaatcacaactgtgaaagatggaggacccatggaactcaccgaagaagtggtagacgagttcatggaagacgttccaatgtctgtcagacttgcgaagtttcgatctcgaaccggaaaaaa

SEQ ID NO: 49 - DNA, 134 bp, Brugmansia mild mottle virus
  source 1..134: mol_type = other DNA
aaggattgcgtgaaaggatcacgaatgttgccgaaggcggttcacttgagctcactgaagaagttgttgagagctttgtgaatgacgtccctatggcagtacgactgaaccatttacgtaatggaaacaaaaaa

SEQ ID NO: 50 - DNA, 134 bp, Yellow tailflower mild mottle virus
  source 1..134: mol_type = other DNA
ccggtctgagagagaaagtaacttccgtgtcagaagggtctccgattgaactcacagaagatgttgtagatgagtttttcgagagtgtccctatggctcgtaggttgcagaacttgaggaataggcgaggaaat

SEQ ID NO: 51 - DNA, 137 bp, Tropical soda apple mosaic virus
  source 1..137: mol_type = other DNA
ttggactgagggagaaaattacaaatgtctcagacggaggacccgtcgaacttacagaagaagttgttgatgagttcgtcgaatcagttcctatggctgagagattacgtaaatttcgaggacggtccaacaaaaag

SEQ ID NO: 52 - DNA, 432 bp, Cucumber green mottle mosaic virus
  source 1..432: mol_type = other DNA
taccctcgtctgtcgtagatattaattctagattcccagatgcgggtttttacgctttcctcaacggtcctgtgttgaggcctatcttcgtttcgcttctcagctccacggatacgcgtaatagggtcattgaggttgtagatcctagcaatcctacgactgctgagtcgcttaacgctgtaaagcgtactgatgacgcgtctacagccgctagggccgagatagataatttaatagagtctatttctaagggttttgatgtttacgatagggcttcatttgaagccgcgttttcggtagtctggtcagaggctaccacctcgaaagcttagtttcgagggtcttctgatggtggtgcacaccaaagtgcatagtgctttcccgttcacttaaatcgaacggtttgctcattggtttgcggaaacctctcac

SEQ ID NO: 53 - DNA, 347 bp, Cucumber fruit mottle mosaic virus
  source 1..347: mol_type = other DNA
tttttgtccttattatgctttgtatgatctgttggtgtcagcccaaggtggagccctgcaaacgcaaaatggtaaagacattttgcgtgactccataaatgggttgttaacgacagttgcgtctcctaggagtcggttccctgcggaagggttctttgtctggtcccgtgagtcgcgcattgctgctatattagattctctgctttcggcgttggattcaagaaatagggctattgaagttgaaaacccttctaatccttcgaccagtgaagctttgaatgctactaagcgcaatgacgacgcgtctactgctgcgcacaacgacattcctcagctgatttcagctt

SEQ ID NO: 54 - DNA, 297 bp, Kyuri green mottle mosaic virus
  source 1..297: mol_type = other DNA
tgttaacttctgttgcgtctctcaattcacgttttcctgctaatgagtttttcgtgtggtctcgtgagtcgcgcattgctgccataatcgattcgttgttatccgctttggattctagaaatagggctatcgaagttgaaaacccttctaatccttctaccggagaagctctgaatgcgaccaagcgcaatgacgacgcgtctacagccgcgcacaacgacattcctctgcttttagcagctctgaatgacggtgtgggcgtttttgatagtgcgtcttttgagtcagctttcggtc

SEQ ID NO: 55 - DNA, 335 bp, Zucchini green mottle mosaic virus
  source 1..335: mol_type = other DNA
tgctgtcttctgttgcgtcacccacttcacagtttccttccggtgtgttttatgtgtggtctcgtgagtcgcgcattgctgctttgatcgattctctcttcggtgctttggattcaagaaatagggctattgaagttgaaaacccttctaatccatcgactggcgaagctttgaacgcggttaagcgcaatgacgacgcgtctacagccgctcacaacgacattcctcagattttatctgctctgaatgaaggtgcgggcgtttttgatagagcgtcttttgaatctgcttttggtctcgtgtggaccgcaggttcgtctacctcgtcttgaggc

SEQ ID NO: 56 - DNA, 238 bp, Cucumber mottle virus
  source 1..238: mol_type = other DNA
tcttttcctcgcccgtgagtcctaccgtcagatttcctgacggagttttttatgtgtttttaggtaatcctgttttggatccgctttttaaagctctgttacagtcgttggatacaagaaatagggtcatagaggttgataacccttctaatcctacgactgctgagtctttaaacgctgtccagcgtactgacgattctactgtcagttcgcgtgtgggtttaataaacttgcgtgc

SEQ ID NO: 57 - DNA, 238 bp, Watermelon green mottle mosaic virus
  source 1..238: mol_type = other DNA
ttttcacctctcctgtgagtccgaccgttagatttcctgacggtccgtttttcattttcttagggaatcctgtgttggatccgctttttaaagctcttctgcagtcgctggatacaagaaatagggttattgaggttgacaatccttctaatcctactactgcggaatctttgaacgcgattcagcgtactgacgactcttccgtcagttcgcatgtcggtctagttaaccttcgcgc

SEQ ID NO: 58 - DNA, 246 bp, Turnip vein-clearing virus
  source 1..246: mol_type = other DNA
agggtttgagggaaaaggtcgtcgcaataaatgatccggacgtcgaaggtttcgaaggtgtggttgacgaattcgtcgattcggttgcagcatttaaagcggttgacaatttcaggaagaggaaaaagaaggttgaagaaagggatgtagtaagtaagtataaatatagaccggagaaatacgccggtcctgattcgtttaatttaaaagaagaaaatgtcttacaacattacaaacccgaatcag

SEQ ID NO: 59 - DNA, 246 bp, Ribgrass mosaic virus
  source 1..246: mol_type = other DNA
agggtttgagagaaaagatcatcgcgataagtgatccggacgtcgaaggtttcgaaggagtggttgacgatttcgttgattcggtcgaagcatttagagcggttgataatttcaggaaaaagaaaaggaagataggagaaaaggaagcggtaagtaggaataagtacagaccggagaaacacgccggtcctaattcgttatatattaaagaagaaaatgtcttacaacatcacgagctcgaatcag

SEQ ID NO: 60 - DNA, 246 bp, Wasabi mottle virus
  source 1..246: mol_type = other DNA
agggtttaagagaaagagtcatcgctgtagatgatccgaacgttgagggtttcgaaggtgtagttgacgaattcatcgattcggttgcagcatttaaagcggttgacaatttcaggaaaaagaaaaggaagattggaggaagggatgtgattagtaagtataagtatagaccagagaagtacgccggtcctgattcgttacttaataaagaagaaaatgtcatacaacatcacgaactcgaatcag

SEQ ID NO: 61 - DNA, 249 bp, Youcai mosaic virus
  source 1..249: mol_type = other DNA
aaggtttgagggaaaaagtcatcgctgtgaatgatccgaacgtcgaaggtttcgaaggtgtggttgacgatttcgtcgattcggttgctgcattcaaggcgattgacagtttcaggaagaaaaagaaaaggattggaggaagggatgtaaatagtaataagtatagatatagaccggagagatacgccggtcctgattcgttacaatataaagaagaaaatggtttacaacatcacgagctcgaatcag

SEQ ID NO: 62 - DNA, 258 bp, Streptocarpus flower break virus
  source 1..258: mol_type = other DNA
agggtttgcgtgaaaggcttaataatgtgggagatccaaatgttgaagtttcagaagttgtcgttgatgagttcgtggactcgatttccgcttcacagtcgttaagccgtgctcgtaataaatacgttcgtggtaatggtaaggttgggaataatagtggtggttttagtaagtataatcgtcatcagccggagaggttcgccggcaaggctatgtataattctaaaaatgtcgtacgtggtggtacttccgaaccaa

SEQ ID NO: 63 - DNA, 333 bp, Rattail cactus necrosis-associated virus
  source 1..333: mol_type = other DNA
tgcttttatgacaggatcttacccaacaattcgactgtgctcaacgactatgacagtttcaccttgagagtgagagacattcatctcaacttggacgattgtagactcgacctgtcaaaggacgatccagcaatctgtcggaggcagtcgggttatctgcgtcccgttcttagaaccggtacggagagacctcgacagcccgggctcattgagaatgtcttagctcttatcaagagaaatttcaatgcacctcatcttcttggaactgtagacgtcgatgcaatggccgacaccgtagtggataagttttttaaaattttcttccctgatggt

SEQ ID NO: 64 - protein, 159 aa, Tobacco mosaic virus
MSYSITTPSQFVFLSSAWADPIELINLCTNALGNQFQTQQARTVVQRQFSEVWKPSPQVTVRFPDSDFKVYRYNAVLDPLVTALLGAFDTRNRIIEVENQANPTTAETLDATRRVDDATVAIRSAINNLIVELIRGTGSYNRSSFESSSGLVWTSGPAT

SEQ ID NO: 65 - protein, 159 aa, Tobacco mild green mosaic virus
MPYTINSPSQFVYLSSAYADPVQLINLCTNALGNQFQTQQARTTVQQQFADAWKPVPSMTVRFPASDFYVYRYNSTLDPLITALLNSFDTRNRIIEVDNQPAPNTTEIVNATQRVDDATVAIRASINNLANELVRGTGMFNQAGFETASGLVWTTTPAT

SEQ ID NO: 66 - protein, 159 aa, Tomato mosaic virus
MSYSITSPSQFVFLSSVWADPIELLNVCTNSLGNQFQTQQARTTVQQQFSEVWKPFPQSTVRFPGDVYKVYRYNAVLDPLITALLGAFDTRNRIIEVENQQSPTTAETLDATRRVDDATVAIRSAINNLVNELVRGTGLYNQNTFESMSGLVWTSAPAS

SEQ ID NO: 67 - protein, 157 aa, Pepper mild mottle virus
MAYTVSSANQLVYLGSVWADPLELQNLCTSALGNQFQTQQARTTVQQQFSDVWKTIPTATVRFPATGFKVFRYNAVLDSLVSALLGAFDTRNRIIEVENPQNPTTAETLDATRRVDDATVAIRASISNLMNELVRGTGMYNQALFESASGLTWATTP

SEQ ID NO: 68 - protein, 161 aa, Paprika mild mottle virus
MPYTVSSPNQLVYFGSVWADPIALIDLCTVSLGNQFQTQNARTTVQQQFSDLFKTVPTRTIRFSDGENGFRVFRYNSTLDPLITALLNSFDTRNRIIETENPANPNTAEIASATQRVDDATVSIRACINNLMNELARGTGMLNTASFETVSNLTWTTAATT

SEQ ID NO: 69 - protein, 160 aa, Bell pepper mottle virus
MSYTVNSPSQLVYLSSAWADPTDLLNLCTNSLGNQFQTQQARTTVQQQFSDVWKPTPQAGVRFPASGFKVYRYNAVLDPLITALLGTFDTRNRIIEVENQQNPTTAETLDATRRVDDATVAIRSAINNLANELVRGTGMYNQTSFESMAGLTWTTTPPSG

SEQ ID NO: 70 - protein, 159 aa, Tomato mottle mosaic virus [sequence omitted]

SEQ ID NO: 71 - protein, 158 aa, Odontoglossum ringspot virus
MSYTITDPSKLAYLSSAWADPNSLINLCTNSLGNQFQTQQARTTVQQQFADVWQPVPTLTSRFPAGAGHFRVYRYELILEPLITFLMGTFDTRNRIIEVRNPQNPTTTETLDATRRVDDATVAIRSAINNLLNELVRGNGMYNQVSFETMSGLTWTSS

SEQ ID NO: 72 - protein, 161 aa, Obuda pepper virus
MPYTVTSPSQLVYFGSVWADPITFIDLCTVALGNQFQTQNARTTVQQQFSDLFKTVPTRTNRFNDGENGFRVFRYNSTLDPLISALMNSFDTRNRIIEVDNPANPNTSEVASATQRVDDATVNIRACINNLMNELVRGTGMMNTASFETVSNLTWTTTTTT

SEQ ID NO: 73 - protein, 159 aa, Rehmannia mosaic virus
MSYTIATPSQFVYLSSAWADPVELINLCTNALGNQFQTQQARTVVQRQFSEVWKPSPQVTVRFPANDFKVYRYNAVLDPLVTALLGAFDTRNRIIEVENQANPTTAETLDATRRVDDATVAIRSAINNLVVELIRGTGSYNRSAFESSSGLVWTSGPAT

SEQ ID NO: 74 - protein, 159 aa, Brugmansia mild mottle virus
MAYTITAPNQIVYLGVAYADPILLMNLCTTSQGNQFQTQNARTTVQQQFADIWKAVPAVNIRFPENGFLVYRYNAVLDQLVTSLLNSFDTRNRIIEVENPPNPTNGEIMSATQRVDDATVNIRASITNLMNELVRGTGFLNRSSFESTSGLTWSTAPTT

SEQ ID NO: 75 - protein, 158 aa, Yellow tailflower mild mottle virus
MSYAITSPKQFAYLTNAYADPIALISLCNNALGNQFQTQNARTTVQQQFNDIWKELPTQISRFPVGIYRVYRFDSTIDPLITSVLNSFDTRNRIIETENPANPSTTEVVNATQRVDDATVNIRSSINNLCNELIRGTGFLNQATFEEASQLTWTARTT

SEQ ID NO: 76 - protein, 160 aa, Tropical soda apple mosaic virus
MSYTISNPNQLVYLASVWADPTELLNLCTSALGNQFQTQQARTTVQQQFSDVWKTVPATNIRFPNAGFKVYRYNAVLDSLITALLGSFDTRNRIIEVENPQNPTTAETLDATRRVDDATVAIRSSINNLMNELVRGTGMYNQAQFESVSGLTWATTATSS

SEQ ID NO: 77 - protein, 161 aa, Cucumber green mottle mosaic virus
MAYNPITPSKLIAFSASYVPVRTLLNFLVASQGTAFQTQAGRDSFRESLSALPSSVVDINSRFPDAGFYAFLNGPVLRPIFVSLLSSTDTRNRVIEVVDPSNPTTAESLNAVKRTDDASTAARAEIDNLIESISKGFDVYDRASFEAAFSVVWSEATTSKA

SEQ ID NO: 78 - protein, 162 aa, Cucumber fruit mottle mosaic virus
MSYSTSGLRSLPAYTKSFCPYYALYDLLVSAQGGALQTQNGKDILRDSINGLLTTVASPRSRFPAEGFFVWSRESRIAAILDSLLSALDSRNRAIEVENPSNPSTSEALNATKRNDDASTAAHNDIPQLISALNDGAGVFDRASFESQFGLVWTAASSSTSK

SEQ ID NO: 79 - protein, 161 aa, Kyuri green mottle mosaic virus
MSYSTSGIRSLPAFAKSFYPFYDVYNLLVSAQGGALQTQNGKDILRESLTGLLTSVASLNSRFPANEFFVWSRESRIAAIIDSLLSALDSRNRAIEVENPSNPSTGEALNATKRNDDASTAAHNDIPLLLAALNDGVGVFDSASFESAFGLTWTASATSSK

SEQ ID NO: 80 - protein, 161 aa, Zucchini green mottle mosaic virus
MPYSTSGIRSLPAFSKSFFPYLELYNLLITNQGAALQTQNGKDILRESLVGLLSSVASPTSQFPSGVFYVWSRESRIAALIDSLFGALDSRNRAIEVENPSNPSTGEALNAVKRNDDASTAAHNDIPQILSALNEGAGVFDRASFESAFGLVWTAGSSTSS

SEQ ID NO: 81 - protein, 162 aa, Cucumber mottle virus
MAYSPITPTNLSLFSSNYVPFTEFYNYLVTAQGEAFQTQQGRDSVRDSLSGFFSSPVSPTVRFPDGVFYVFLGNPVLDPLFKALLQSLDTRNRVIEVDNPSNPTTAESLNAVQRTDDSTVSSRVGLINLRAAITQGNGVVNRSIFESSNGLTWATSGSSSSK

SEQ ID NO: 82 - protein, 162 aa, Watermelon green mottle mosaic virus
MAYTPITPTNLPLFSSNYVPYTEFYNYLVSAQGEAFQTQQGRDAVRTTLSGFFTSPVSPTVRFPDGPFFIFLGNPVLDPLFKALLQSLDTRNRVIEVDNPSNPTTAESLNAIQRTDDSSVSSHVGLVNLRAAIAQGNGVVNRSIFESSSGLTWATSSASTSK

SEQ ID NO: 83 - protein, 157 aa, Turnip vein-clearing virus
MSYNITNPNQYQYFAAVWAEPIPMLNQCMSALSQSYQTQAARDTVRQQFSNLLSAVVTPSQRFPDTGSRVYVNSAVIKPLYEALMKSFDTRNRIIETEEESRPSASEVANATQRVDDATVAIRSQIQLLLSELSNGHGYMNRAEFEALLPWTTAPAT

SEQ ID NO: 84 - protein, 157 aa, Ribgrass mosaic virus
MSYNITSSNQYQYFAAVWAEPTPMLNQCVSALSQSFQTQAGRDTVRQQFSNLLSAIVAPNQRFPDTGFRVYVNSAVIKPLYEALMKSFDTKNRIIETEEESRPSASEVANATQRVDDATVAIRSQIQLLLNELSNGHGYMNRAEFEAILPWTTAPAT

SEQ ID NO: 85 - protein, 157 aa, Wasabi mottle virus
MSYNITNSNQYQFFAAVWAEPIAMLNQCISALSQSYQTQAARDTVRQQFSNLLSAIVTPNQRFPETGYRVYVNSAVLKPLYEALMKSFDTRNRIIETEEESRPSASEVANATQRVDDATVAIRSQIQLLLSELSSGHGLMNRAEFEVLIPWATAPAK

SEQ ID NO: 86 - protein, 157 aa, Youcai mosaic virus
MVYNITSSNQYQYFAAMWAEPTAMLNQCVSALSQSYQTQAARDTVRQQFSNLLSAIVTPNQRFPEAGYRVYINSAVLKPLYESLMKSFDTRNRIIETEEESRPSASEVANATQRVDDATVAIRSQIQLLLNELSNGHGLMNRAEFEVLLPWATAPAT

SEQ ID NO: 87 - protein, 157 aa, Streptocarpus flower break virus
MSYVVVLPNQLQFFTNAWADPIQLMNLCSASLSQIFQTQAARDAVREQFGNTLRSVVTQTTRFPEAGFQVYINDAALKPLWENLLKSFDTKNRILETEEETRPSTAEVLNATQRVDDSTTAIRGALQRLSDELNRGSGYMNRTSFETILLWSAATAK

SEQ ID NO: 88 - protein, 170 aa, Rattail cactus necrosis-associated virus
MPYINVQPKDFVYLTRSWVDPQRLIQFLSDMQTQAFQAQQSRTQLLNELSTMVVYGPTKSDRFPIDTYLINITKGGLSAYWFGLTQSADTKDRVFEVSEARAVTNAESKLATQRVDDATVAIRNAIKSTLSYLIAGEDIYSRTSFEAALGWIWQENLPPPPQTAASDSRT

SEQ ID NO: 89 - protein, 268 aa, Tobacco mosaic virus
MALVVKGKVNINEFIDLTKMEKILPSMFTPVKSVMCSKVDKIMVHENESLSEVNLLKGVKLIDSGYVCLAGLVVTGEWNLPDNCRGGVSVCLVDKRMERADEATLGSYYTAAAKKRFQFKVVPNYAITTQDAMKNVWQVLVNIRNVKMSAGFCPLSLEFVSVCIVYRNNIKLGLREKITNVRDGGPMELTEEVVDEFMEDVPMSIRLAKFRSRTGKKSDVRKGKNSSNDRSVPNKNYRNVKDFGGMSFKKNNLIDDDSEATVAESDSF

SEQ ID NO: 90 - protein, 256 aa, Tobacco mild green mosaic virus
MAVSLRDTVKISEFIDLSKQDEILPAFMTKVKSVRISTVDKIMAVKNDSLSDVDLLKGVKLVKKGYVCLADLVVSGEWNLPDNCRGGVSVCIVDKRMKRSKEATLGAYHAPACKKNFSFKLIPNYSITSEDAEKHPWQVLVNIKGVAMEEGYCPLSLEFVSICVVHKNNVRKGLRERILSVTDGSPIELTEKVVEEFVDEVPMAVKLEKVPENKKEMVGNNVNNKKINNSGKKGFKIEEIEDNVSDDESIASSSTF

SEQ ID NO: 91 - protein, 264 aa, Tomato mosaic virus
MALVVKGKVNINEFIDLSKSEKLLPSMFTPVKSVMVSKVDKIMVHENESLSEVNLLKGVKLIEGGYVCLVGLVVSGEWNLPDNCRGGVSVCMVDKRMERADEATLGSYYTAAAKKRFQFKVVPNYGITTKDAEKNIWQVLVNIKNVKMSAGYCPLSLEFVSVCIVYKNNIKLGLREKVTSVNDGGPMELSEEVVDEFMENVPMSVRLAKFRTKSSKRGPKNNNNLGKGRSGGRSKPKSFDEVEKEFDNLIEDEAETSVADSDSY

SEQ ID NO: 92 - protein, 257 aa, Pepper mild mottle virus
MALVVKDDVKISEFINLSAAEKFLPAVMTSVKTVRISKVDKVIAMENDSLSDVNLLKGVKLVKDGYVCLAGLVVSGEWNLPDNCRGGVSVCLVDKRMQRDDEATLGSYRTSAAKKRFAFKLIPNYSITTADAERKVWQVLVNIRGVAMEKGFCPLSLEFVSVCIVHKSNIKLGLREKITSVSEGGPVELTEAVVDEFIESVPMADRLRKFRNQSKKGSNKYVGKRNDNKGLNKEGKLFDKVRIGQNSESSDAESSSF

SEQ ID NO: 93 - protein, 269 aa, Paprika mild mottle virus
MSSKSIVNIEEFINMSKAEEVLPAALTRMKSVRISTVDKIMATDNDNISEVDLLKGVKLIKNGYVCLVGLVVSGEWNLPDNCRGGVSVCLIDKRMQRHNEATLGSYTAKASKKNFSFKLIPNYSITSQDAERRPWEVMVNIRGVAMEEGWCPLSLEFVSVCIVHKNNVRKGLREKVTTVSEDSAIELTEEVVDEFIEAVPMARRLQNFRKPKNNISKNFVNKGSSKPRNIPKLNEDKVFKLEKGLKGVKGMTNASRDDSSSEISSDSFN

SEQ ID NO: 94 - protein, 278 aa, Bell pepper mottle virus
MAIVVKDKVNVNDFINLSNSEKYLPSNSEKYLPSLMTPVKSVRISKVDKVLARENETLSEVDLLKGVKLIEGGYICLAGLVVTGEWNLPDNCTGGVSVCLVDKRMERASEATLGSYYTGAAKKRFQFKVTPNYSVTTDDAKKNIWQVLVNIKGVRMSAGFCPLSLEFVSVCIVFKNNIKLGLREKITRVTDAGPMELTEEVVDEFIENVPMAARLARFRTKSSKTGPKKFVRNSRDSKVRSNNLNRGVRPKFEEEGIVSDKLINDESESIDADSDSYL

SEQ ID NO: 95 - protein, 268 aa, Tomato mottle mosaic virus
MALTVSGKVRISEFIDLSKSERLLPSMFTHVKSVSVSKVDKVMVNEEDSLSEVNLLKGVKLIDGGYVCLAGLVVSGEWNLPDNCRGGVSICLVDKRMQRADEATLGSYYTGAAKKRFQFKIVPNYAITTKDAERNIWQVLVNIRNVKMAGGFCPLSLEFVSVCIVYKNNIKLGLREKITRVDDAGPIELTEEVVDEFMESVPMSVRLAKFRTKSSKRGPKHNSNNTNERKGRSNFRKKQDQESYGVSDSLDNLIEDDTETSVAGSDSY

SEQ ID NO: 96 - protein, 303 aa, Odontoglossum ringspot virus
MGRLRFVVLLSIFPIKTFSEPCYTMALVLRDSIKISEFINLSAFEKLLPSALTAVKSVRIPKVDKIISYENDTLSDIDLLKGVKLVENGYVCLAGLVVTGEWNLPDNCKGGVSICLVDKRMKRANEATLGSYHTSACKKRFTFKIIPNYSVTTADALKGIWQVMTNIRGVEMEKGFCPLSLEFVSICVVYLNNIKLGLREKILNVTEGGPTELTEAVVDRFVEKVPMAARLKSFRSVNKKKPSNSSKFVNGKSRLNSRNKLNYENGDSDVGTSVVDDIVVGNGVSDIRIDDDCESFDAQSESY

SEQ ID NO: 97 - protein, 274 aa, Obuda pepper virus
MSKAIVKIDEFIKLSKSEEVLPSAFTRMKSVRVSTVDKIMAKENDNISEVDLLKGVKLVKNGYVCLVGLVVSGEWNLPDNCRGGVSICLIDKRMQRHNEATLGSYTTKASKKNFSFKLIPNYSITSQDAERRPWEVMVNIRGVAMSEGWCPLSLEFVSVCIVHKNNVRKGLREKVTAVSEDDAIELTEEVVDEFIEAVPMARRLQNLRKPKYNKEKENKNLNNKNSIGVSKPVGLERNKVRSVVRKGVRSDSSLGVTDMSQDGSSSEISSDSFI

SEQ ID NO: 98 - protein, 267 aa, Rehmannia mosaic virus
MALVVKGKVNIGEFIDLTKTEKLLPSMFTPVKSVMCSKVDKVMVHENESLSEVNLLKGVKLIENGYVCLAGLVVTGEWNLPDNCRGGVSVCLVDKRMERADEATLASYYTAAAKKRFQFKVVPNYAITTHDAMKNVWQVLVNIRNVKMSAGFCPLSLEFVSVCIVYRNNIKLGLREKITTVKDGGPMELTEEVVDEFMEDVPMSVRLAKFRSRTGKKNNVKKVKFEGVDRSVPKMNKGKSRNNGGVFERNIFIDNDSETNVAEPDSF

SEQ ID NO: 99 - protein, 271 aa, Brugmansia mild mottle virus
MTLSIRDSFKIDEFINLSKVEKAVPALFSRVKTVRVSTVDKIMATKNDSLSDVDLLKGVKLVNNGYVCLVGLVVSGEWNLPDNCKGGVSVCLVDKRMKRANEATLGSYHSRACKKNFSFKLIPNYSITTADAEKQPWQVLVNIRGVQMEQGYCPLSLEFVSVCIVHKNNVRKGLRERITNVAEGGSLELTEEVVESFVNDVPMAVRLNHLRNGNKKEGFSKGKYVNNNAKERSVNKFVKKSVNGKGGLKVKEISTSVEDYNSSEVSSDSFI

SEQ ID NO: 100 - protein, 266 aa, Yellow tailflower mild mottle virus
MAIALRDTVKINEFINLSKTEEILPAMFTRMKSVRISTVDKVVAKENDSVSEVDLLKGVKLVKNGYVNLVGLVVSGEWNLPDNCRGGVSVCLVDRRMTRHSEATLGSYTAPACKKNFSFKLIPNYSVTTADAERRPWEVMVNIKGVAMAEGWCPLTLEFVCVCIVHKTNVRTGLREKVTSVSEGSPIELTEDVVDEFFESVPMARRLQNLRNRRGNINRNKSQVYKKKNKNNIGDALKERIDEVKDVENKRYDNDDYSIEESSDSY

SEQ ID NO: 101 - protein, 256 aa, Tropical soda apple mosaic virus
MALVVKDDVKISEFINLSTSEKFLPAAMTSVKSVRVSKIDKVIATENDSLSDVDLLKGVKLIEEGYVCLAGLVVSGEWNLPDNCRGGVSVCLVDKRMLRHDEATLGSYKTGAAKKRFAFKLIPNYSVTTADAKRNIWQVLVNIKGVAMEKGFCPLSLEFVSVCIVHKTNIKLGLREKITNVSDGGPVELTEEVVDEFVESVPMAERLRKFRGRSNKKSNKFVEKNNNKRGDKGGKLLKKIDNETETESSDAESSSY

SEQ ID NO: 102 - protein, 264 aa, Cucumber green mottle mosaic virus
MSLSKVSVENSLKPEKFVKISWVDKLLPNYFSILKYLSITDFSVVKAQSYESLVPVKLLRGVDLTKHLYVTLLGVVVSGVWNVPESCRGGATVALVDTRMHSVAEGTICKFSAPATVREFSVRFIPNYPVVAADALRDPWSLFVRLSNVGIKDGFHPLTLEVACLVATTNSIIKKGLRASVVESVVSSDQSIVLDSLSEKVEPFFDKVPISAAVMARDPSYRSRSQSVGGRGKRHSKPPNRRLDSASEESSSVSFEDGLQSDHT

SEQ ID NO: 103 - protein, 258 aa, Cucumber fruit mottle mosaic virus
MSISKVGVRNALKPEEFVKITWVDKLLPDAFTILKYLSITDYSVVQSKDYEHLIPVDLLRGVDFSKSKYVTLVGVVISGVWTIPENCAGGATVALVDTRMSLVSEGTICKFSVSAASRDFTVKLIPNYYVTAADASSKPWSLFVRISGVRIKDGFSPLTLEIASLVATTNSILKKGLRVSVIESVVGSDASVSLDTLSEKVQPFFDSVPITASVVSRDRSYVSKGRPPSRSGPVSRKSKSKSEAESFSDSGASEPLSS

SEQ ID NO: 104 - protein, 262 aa, Kyuri green mottle mosaic virus
MSVSSVGVKNALKPQEFVKLSWVDKVLPDMFTVFRYLSVTDYSVIKSRDSECLIPVDLLRGVDLSKSKYVTLVGVVISGVWTIPENCAGGATVALVDTRMSMVDEGTICKFSVAASTRDFMVKLIPNYYVTASDASSKPWSIFVRVSGVRIKEGFSPLTLEIASLVATTNSILKKGLRVSVLESVVGSDASINLDSVSDKVQPFFDSVPITAAVIARDRSYVSKSGPSRAVRPRPQSKSGKKGDANPAESMSDGDAYEPPRL

SEQ ID NO: 105 - protein, 261 aa, Zucchini green mottle mosaic virus
MSVSKLGVKNVLKPQEFVKLNWVDKVLPDMFTVFRYLSVTDYSVIKSRDSECLIPVDLLRGVDLSKSKYVTLVGVVISGVWTIPENCAGGATVALVDTRMSMVDEGTICKFSVAASARDFMVKLIPNYYVTATDASSKPWSIFVRVSGVRIKEGFSPLTLEIASLVATTNSILKKGLRVSVLESVVGSDASVNLESASEKVQPFFDSVPITAAVISRDRSYVSKSGFNRAVRSKPPSKGGKKFGDSAESLSEDSASELPGL

SEQ ID NO: 106 - protein, 262 aa, Cucumber mottle virus
MSISNLSVESQLKPSNFVKLSWVDKLLPDYFSILRFLSVTDHSVIKAREYESFLPVELLRGVDLTKHKYVTLLGVVISGVWTIPEGCSGGATVGLVDTRMERVVEGTVCKFSVPASVREFNVRFIPNYSITAADAARHPWSLFVRLKGVNIKDSFSPLTLEIAALVATTNSIIKKSLKAIVSDVVVGSDAAVAIADRDSQVNSFFDSVPITKSVVNFDKSYKSRVPKKDSSGGSGKVKRSTGTSGPADTEFSDDGLLSNHSD

SEQ ID NO: 107 - protein, 262 aa, Watermelon green mottle mosaic virus
MSISNLSVESQLKPSNFVKLSWVDRLLPDYFSILRFISVTDHSVVKAREYESFLPVELLRGVDLTKHKYVTLLGVVISGVWTIPEGCSGGATIGLVDTRMERVSEGTVCKFSVPASVREFNVRFIPNYSITASDAARHPWSLFVRLKGVSIKDSFSPLTLEIAALVATTNSIIKKSLKAVVSSVVVGSDAAVAIEDKDSSVNSFFDSVPITKSVINFDKSYKSKVPRKGSSVVSVKGKAGVGTSGPTDTEFSDYGLHSDHTD

SEQ ID NO: 108 - protein, 267 aa, Turnip vein-clearing virus
MSIVSYEPKVSDFLNLSKKEEILPKALTRLKTVSISTKDIISVKESETLCDIDLLINVPLDKYRYVGILGAVFTGEWLVPDFVKGGVTISVIDKRLVNSKECVIGTYRAAAKSKRFQFKLVPNYFVSTVDAKRKPWQVHVRIQDLKIEAGWQPLALEVVSVAMVTNNVVMKGLREKVVAINDPDVEGFEGVVDEFVDSVAAFKAVDNFRKRKKKVEERDVVSKYKYRPEKYAGPDSFNLKEENVLQHYKPESVPVLRSGVGRAHTNA

SEQ ID NO: 109 - protein, 267 aa, Ribgrass mosaic virus
MSMVSYEPKVNDFLFLTNKEKILPKALTRLKTVSISTKDIISVKESETLCDIDLLIDVPLDKYRYVGILGAVFTGEWLVPDFVKGGVTISVIDKRLVNSKECVIGTYRAAAKSKRFQFKLVPNYFVSTADAKRKPWQVHVRIQDVKIEAGWQPLALEVVSVAMVANNVVMKGLREKIIAISDPDVEGFEGVVDDFVDSVEAFRAVDNFRKKKRKIGEKEAVSRNKYRPEKHAGPNSLYIKEENVLQHHELESVPVLRSGVGRTHTNA

SEQ ID NO: 110 - protein, 267 aa, Wasabi mottle virus
MSTVSYKPKVSDFLSLSRTEEILPKALTRLKTVSVSTKDVISVKESESLCDIDLLVNVPLDKFRYVGILGVVFTGEWLIPDFVKGGVTVSVIDKRLENSKECIIGTYRAAAKDRRFQFKLVPNYFVSVTDAKRKPWQVHVRIQNLKIEAGWQPLALEVVSVAMVTNNVVVKGLRERVIAVDDPNVEGFEGVVDEFIDSVAAFKAVDNFRKKKRKIGGRDVISKYKYRPEKYAGPDSLLNKEENVIQHHELESVPVFCSGMGRAHSDA

SEQ ID NO: 111 - protein, 265 aa, Youcai mosaic virus
MSYEPKVSDFLALTKKEEILPKALTRLKTVSISTKDVISVKESESLCDIDLLVNVPLDKYRYVGVLGVVFTGEWLVPDFVKGGVTVSVIDKRLENSKECIIGTYRAAAKDRRFQFKLVPNYFVSVADAKRKPWQVHVRIQNLKIEAGWQPLALEVVSVAMVTNNVVVKGLREKVIAVNDPNVEGFEGVVDDFVDSVAAFKAIDSFRKKKKRIGGRDVNSNKYRYRPERYAGPDSLQYKEENGLQHHELESVPVFRSDVGRAHSDA

SEQ ID NO: 112 - protein, 288 aa, Streptocarpus flower break virus
MAIVLSKPKVSEFLNLTKAEEILPKFLTRLKTVAISTRDVVSVKGTTDLVDIDLLRDVPVNNWRYVGIVGIVASGEWLLPDNVSGGVAISFVDKRLVDSREAILGTYRAAAVEKRFQFKLIPNYFVSQEDALRRPWQVQVSLKGLKFEEGFSPLTLEFVSVVVCANSVVTKGLRERLNNVGDPNVEVSEVVVDEFVDSISASQSLSRARNKYVRGNGKVGNNSGGFSKYNRHQPERFAGKAMYNSKNVVRGGTSEPTAILHKRMGGSNSIDESLFSVAESDLSDSGCA

SEQ ID NO: 113 - protein, 334 aa, Rattail cactus necrosis-associated virus
MSSLCVSDPAVLLSPELHLKVPQLKSLVQFWKKPFKTCSISMSDVIKVASSNPLSIAVDFSSAMPSGPRNFKYVYILAVVLTGRWHLSESCPGGATFVLYDKRLCGRAEGIYGSFFSKVSASKFQVRFSVGHSMTVNDLLRNPLHLCFSLESVPCQEGYEPLSVEVSSLQLFTDCILEESLSAKLVKYPALCTDNMSVISNVDDVIFKFNSVLNVDNVPNSVKNVVKCNKVFKGRRSRGKWVGSQNEVVVKDGTNVTPHRLIAKDALHQRTTERLRLPDQVMGRPPASDTVSERYADSGFPSTAVSHTTSERTVDDGGLRSDQIGPFPYRYVPY

SEQ ID NO: 114 - DNA, 4759 bp, Arabidopsis thaliana
  source 1..4759: mol_type = other DNA
ttcattcatcatcttcctcctctctctcttctctgtatcacccaactaaatcctcacgggattagatccaaagtctcaaactttgatccaaaaacacaaactttgttcaaaagacataaactttgagccaaagtcacaagctttcttggtgaacgatggattacaatccaaatcttcctcctttaggaggaggtggtgttagtatgagaagaagcataagtcgaagtgtaagcagagcaagtaggaacattgaagatatcttctcatctggttcaagaagaacacaatcagtcaacgacgatgaagaagctcttaaatgggctgccattgagaagctaccaacttacagtcgtctccgaaccactctcatgaacgctgtagtcgaagacgatgtttacggtaaccagctcatgagcaaggaggttgatgtaaccaagcttgatggtgaagatcgtcagaagtttattgacatggttttcaaagtagctgagcaagataatgaaaggatcttgactaagctaagaaacaggatcgatagagttggtatcaaacttccaactgttgaagtcaggtacgagcatttgacgattaaagctgattgttacactggtaatagatctcttcctacacttttgaatgttgtgaggaacatgggagagtctgctttaggtatgattggtattcaatttgctaagaaagctcagcttacgattcttaaagatatctctggggttattaaacctggaaggatgacacttttgttgggtcctccttcttctggtaagaccactcttttgttggctttagctgggaaacttgataaatctctacaagtcagtggtgatattacttacaatggttaccaactcgatgagtttgttccgagaaagacctctgcttacattagtcagaacgatcttcatgttggtatcatgactgttaaggagactcttgacttctctgctaggtgtcaaggtgttggtactcgttatgatctgttgaatgagcttgcgaggagagaaaaggacgctggtatattcccggaagccgatgttgatctcttcatgaaagcttctgctgctcaaggtgttaagaacagtctcgtcactgattatactctcaaaattttggggcttgacatttgcaaagacacaatagttggagatgacatgatgagaggtatatctggaggtcagaagaaacgtgtcacaactggtgagatgattgttggacctactaagacactcttcatggacgaaatatccactggtcttgacagttccactactttccaaatcgtcaagtgtctgcaacaaatcgttcacctcaatgaagccacggtgctcatgtctctcctccagcctgctcctgagacttttgatttattcgatgatatcatcttggtgtcggaaggtcagatcgtgtaccaaggaccgagagacaacattcttgagttctttgagagctttgggttcaagtgtcctgagagaaaaggaacagctgatttcctgcaagaggttacttccaagaaagatcaagaacagtactgggtgaacccgaacagaccttatcactacattccggtttcagagtttgccagtagatacaagagtttccatgttgggacgaagatgtctaacgaacttgcagtaccgttcgataagtctcgcggccacaaagcagctcttgtgttcgataagtactctgtctcaaagagggagcttctcaagagctgttgggacaaagagtggctgcttatgcagcgaaacgcgttcttctatgttttcaagactgtccagatcgtcatcattgctgcaatcacgtctacactcttcctgagaaccgaaatgaacacaagaaacgagggtgatgctaatctctacataggagcattgctatttggaatgatcatcaacatgtttaatgggtttgcggagatggctatgatggtttcaagactccctgtgttctacaaacagagggatctcttgttttatccatcctggaccttctcacttcccactttcttgcttgggattccaagctcaatattagaatcgacggcttggatggtggtgacttattactccattggttttgcacctgacgccagccgcttcttcaagcagtttcttctggtgtttctgattcaacaaatggctgcatccctctttaggttgattgcttctgtgtgcagaaccatgatgattgctaatactggtggtgctctcactctacttcttgtgttcttgctcggaggcttccttcttccgaaaggcaagattcctgactggtggggttgggcttactgggtatctcctctcacctatgctttcaacggtctagtagtcaatgaaatgtttgctcccagatggatgaacaaaatggcttcttctaacagcacaataaagcttggaactatggtgcttaatacttgggatgtctaccatcaaaagaactggtactggatttcagttggagccttgctttgtttcacagccctcttcaacattctattcaccttggcacttacctatctcaaccctcttgggaagaaggcaggtttacttccagaagaagaaaatgaagacgctgatcaggggaaagatccaatgcgtagatctttgtctactgcagatgggaacagaagaggagaggtcgcaatggggagaatgagtagggactctgcggctgaagcatcaggtggtgcaggcaataagaaaggaatggttcttcctttcactcctttagctatgtcctttgacgacgtcaaatactttgttgacatgcctggggaaatgagagaccaaggagttacagaaacaagactccaactgcttaaaggtgtgactggtgcatttaggccaggagttttgactgcgcttatgggagtgagtggtgccggtaagactacgcttatggacgttttggccggaaggaaaacaggtggatacattgaaggagatgtgagaatatcaggattcccaaaggttcaagaaacatttgctagaatctcaggatattgtgagcagaccgatattcactccccgcaagtaacagtcagagaatctctgattttctctgctttccttcgtcttcctaaagaagtcggcaaagatgaaaaaatgatgtttgtggatcaagtgatggaattggtagagctggacagtcttagggactccattgttggtttaccgggtgtcacggggctttccacggagcagagaaagagactgacaatcgcggtggagcttgtagccaacccttccatcatctttatggatgagccaacttcagggctagacgctagagcagcggctattgtgatgagggcggtaaggaacacagtggacactggaagaaccgtggtctgcaccattcatcagcctagcattgatatctttgaagcatttgatgaattgatgctgatgaagagaggaggacaagtgatttacgcgggtccattgggtcaaaactctcacaaggtggttgagtactttgaatctttccccggagtgtccaagattccagaaaagtataacccggccacttggatgctcgaagctagctcactcgccgctgagctaaagcttagtgttgactttgctgagttatacaatcaatcagcattgcaccagcgaaacaaagcgttggtaaaagaactaagtgtaccaccagcaggagcatcagatctttactttgctacacaattctcacaaaacacatggggacagttcaaatcatgcttatggaaacaatggtggacgtattggagatctccagactacaatcttgtccgtttcatcttcacattggcaacatctctcttgattggtacagtcttctggcaaatcggaggtaacaggtcgaacgcaggggatctaacaatggtgataggagcattgtatgccgcgattatcttcgtgggaatcaacaactgttcaacagtacaaccgatggttgcagtggaaagaacagtgttctacagagaaagagcagcaggaatgtactcagccatgccatatgccatctctcaagtcacttgtgagcttccctatgtccttattcaaaccgtttactactcactcatcgtctacgccatggttggtttcgaatggaaagccgaaaagttcttctggttcgtcttcgttagctacttctcattcctctactggacttactacggcatgatgactgtttccctcacaccaaaccaacaagtcgcttcgattttcgcctcagcgttttacggtattttcaacctcttctctggtttcttcattccaagacccaaaatcccaaaatggtggatttggtactactggatctgccctgttgcatggaccgtgtatggattgatagtgtcgcagtacggtgatgtggagacacgtatccaagtccttggtggtgctcctgacttaaccgtcaagcaatacattgaggaccattatggtttccaatctgactttatgggaccagtggcggctgtactcatcgctttcaccgtcttcttcgccttcatcttcgccttctgcatcagaactctcaacttccagaccagataaaaccatctctcaaacaacaaagtctctttctttttttgtatcctctgtgttgtttatatgcactataagctttgtatgttctaaatatgtattgtagtgtcataacgaaatttttttgaatatttttatttattgtcttatagatgatgacgaatcggaatcatgtaatataattccacttttttttgtgttta

SEQ ID NO: 115 - DNA, 1642 bp, Arabidopsis thaliana
  source 1..1642: mol_type = other DNA
gcttcacgagacaaacgacgaacaacgcaattacgcgttcttatctttctgggtatttcttaattatattactctatataaataaaaatacccagaaacgtaatttcgtcgagttcaaaaattcaattcaaagaataatttctttccataaaaagattgttgtggattaacttctttcttaaaagaatctcatacccgtcgaatcttcttcttcaacctttttctgcgtttttaatattttccctacaaaaagattctcaaaatcgttttacataaacccgatcttgtcaatctccagaaacaaaaaaaaaaaaatggcgatcaagacaaagactagtctaattccaagttgttcatcacctgaggatctaaaacgcgttttgcaaacgctaggttcgagctggggagatgtagttgaagatctggagcgtcttgaggttgttccgttaaaaggagctatgactaacgaggtttatcagattaattggcctactttaaacggtgaagatgttcatcggaaagttcttgttcggatctacggtgacggcgttgaccttttctttaacagaggtgatgaaatcaaaacgtttgagtgtatgtctcatcatggttatggtcctaagcttcttggtcgtttctctgatggtcgtcttgaagaattcatacacgccagaactctttctgcagatgatcttcgtgtagcagaaacatctgatttcatcgctgcgaagctaagagagtttcataagcttgatatgcctggtccaaagaacgttcttctctgggaaagacttaggacttggcttaaggaggctaagaacttggcttcacctatagagatggataagtatcggttggaaggtttggaaaatgaaatcaatttgttggaagagagacttactcgggatgatcaagagattggtttctgtcacaacgatcttcagtatggaaatgtcatgattgatgaagtaaccaatgccattaccatcatagactatgagtattcgagtttcaacccaattgcttatgacattgcaaaccacttttgtgagatggctgctaattaccattcagacactcctcatgttctggactacactctatatccaggagaaggagaaaggagaaggttcattagcacatatcttggctctacagggaatgcaacaagtgataaagaagtagagaggttattgaaagatgcagagagctacactttagcaaaccatatcttctggggactatggggaatcatctcgggacatgtgaacaagattgagttcgattacatggaatatgcaaggcagagatttgaacagtactggcttagaaagcctttgcttcttgaaggatgaagcagattcgcattgaaaagccgatatacaactaaaagtttctgcaattaggtcaaaagaaaaaaagaaaatttagtagactatatgttgctattgttactctcatcagtttgtgtgtttcttcccttctatatagaggtttgttaactctcaaaacagttaaattgagtaaaacttgttctaaacaaagtattatatgataatagaagaagcaccagtggtctagtggcatgatagtaccctgccacggtacagacccgggttcaattcccggctggtgcaattta

SEQ ID NO: 116 - DNA, 1043 bp, Arabidopsis thaliana
  source 1..1043: mol_type = other DNA
agtttcaaattagtaaacgataaagtagatgataattaaattcatgtcatagccatgaacgaatgttatgttaaaaaaatttcatgtaagtaaattctttggagttcgattcttcttttgtccttacacaatcaaagatttttctttcaactttttttacttaacagcattaactctttctcagatcttcaattgttttcctaaacgaaattatcattaaattgtttaaaaaatacacatttaatataacatatatcataacaagatatattatatttatgaaaaagagatgtagtactacagcatatggtggcaaacaaacccactaaattcagtaaaatggaacccaccaaatttatctataaataagtccccaaacctctcccccaaaaatgcaacaacactcatctttcccaatataagtttttaccaaacaacaacttttgttttgcctttcctcaaaacataattttgtcttattttctaaaccggtaaaagatgtcgctagctatcgcagaagtttacacggtgaggaagtttcacagagagagtatgaagaaaccggccaaacagacggttaccggcgagggagatgaaaagattggcggaggaagtttcaaggaggcgccggtgaagtcaggtgggtgtagaagattcggacggtggttttttgggaagccgggaatgaagaaaagctctgctaaagtttcggatcccatggcgattgagtgatgaagaagaaattaaaacttttctcttctttgccttttttttttttctttctttattttgttttattttcattggtctttttttaatggctttttctagtgtcttctctttttctttattgggtgattttataaatagtcggtaaacattgtacaatatgaactacaaaaatatgagaaaatctatatatgtatgtagaatggatgtattccctaaataccacagctagtttgataagttttatgccaaaccaactaaacttgtatgccacgatatttcgtatttcagaaaatcgaaaattgttatttttt

SEQ ID NO: 117 - DNA, 1428 bp, Arabidopsis thaliana
  source 1..1428: mol_type = other DNA
acaaaaaccatttgaattttctttcttcttcaaaagttcgaaacttttttttttccggcaatggagggactagttccggtacagagacttccaattaaagtggcttcaccttctctgtatcggtgtaacaattctgtctcaatcagacgttcaatttcaggttttgccatggacaggaagataaactttagggctccgtcgcaattctcgatccgagctcaacagtcggatttgaaggaaagcttagctgtgtcttcttcatcagtagaggataaaggaaatgttcttagaatcaaggaatgggaagtagagatgtatcaggaggaattagctattagtcaaggtattaggataaggagaaaaccaccaagtaaggctcctttgggatactctggaccatttgagttgagattgcataacaatgatgctgattctcctcgtaatatcttggaggagatcacatggtacaaagacgtagaagtttcccggatgaaggagctaaatccgcttgacgtgctgaagaaagctgtagaggatgctcctcctactagggattttgttggggctcttaggatggctcataaaagaactggcttccctggcttgatagctgaggttaagaaggcttctccaagtagaggaatcttaaaagagaattttgacccggtcgagattgctcaagcttatgaaaaaggcggagcagcatgcctcagcgttttgacagaccagaagtatttccagggaggctttgaaaacttggaagcaataaggagcgctggtgtgaagtgtccactattatgcaaagagtttgttgtagatccatggcagatctactatgctcggactaaaggcgcagatgcagtactgcttattgctgctgtattggctgacctagaaataaccttcttgcttaagatttgcaagaagcttagcttggctgcccttgttgaggtacatgatgagagagagatgggtcgtgtacttggaatagaaggaatcgagcttgttggcatcaataaccgaagtcttgaaacatttgaagtggacatcagtaatacaaagaagcttcttgaaggagagcatggtagacaaatccgtgagagagacatgattgtggttggcgaatctggtctgtttacaccagatgacattgcctatgtacaagcagccggagtcaaagcagttttggttggagaatccattgtgaagcagaacgaccctgagaaaggaatagctggactttttggcaggaacatttctcatacttagagaccatatcataatacatctccaaatacgtttcctagtacatttgttttgtatcttgctctgtgagtattgaggaaagactagaaaggtttgttggttctgatgtttaagacattttcaaaaaaccatcgaataaactgaatcgaaatcgatttacag

SEQ ID NO: 118 - DNA, 1388 bp, Arabidopsis thaliana
  source 1..1388: mol_type = other DNA
agataagagcgaaacaaattacaaaattgaattacacaataatgtcctctaagcgacgactaccggtgaaatattttataagaaaacaaaaacaataattaacaaacaaaggcgacacctttagattcgacaagacgaccattttagaaaaagcttctcaaattctctccttatccccaaaaattcaaacttttttctctttggaaaattctgaggcaaaaatgcggcgtaattgctgccatgtttcatttgcttcaaccctcaagatccttaattttgtccaagctttcattggtgtttcgatcattatctactccatatggatgctccatgaatacagccgtcaccttcccgtggacccgcctccgtcagcttcatcaagctccggaaccgagatcgctactagtgtatctgagcccttgaagaatcctattgattttgtggcgagtatcattctcgggtctaatggtggtgatcatgggtttaacctacgctcgttggaccttcctgctccatggttcatctactctttcatggcggttggtatattggtctgcattgttaccttcattggtttcatagcagctgaagcaatcaatggctgttgcttgtgtttttactctattctcaaaactctgctcattctacttgaagctgcacttgttgcatacatcgctattgaccgtcactgggaaaaggatcttccgtatgatccaactggagaacttagtagtcttagggctttcattgaagaaaacatcgatatatgcaaatgggtggggattgctgtggtagcagtccagctactgtcattgctactagccatggttctcagagcgatggtttcaaccccgaaacccgaacttgacgaagaggaagatgatgagaacccaaggagtagaacttgggacccacttcttggtccgcaaggaaaccaagcgcctgctggctcaagcaagattgaaaactggagctcccgaatcagagaaaagtatggtttgaaccagagtccaccggtgaacccgaaaggttgatgaagccaaataatcatgtttctaaaactgcatgtgtccatatggtctctgtgaagctctctttctctatgttttgctctttgcaacttctcgagtgtgcataaacatttactcaaaacagtgctgtattgtgtttacacaaacggcataagcatcttcgtttgtgtgtttgcttgtacaaacaatcctgtgaacagtttgaagttagcatttccactataacgtttcgattcaatttataatgaagaaaacaaaactaaaaattgaattggacatcataaacagattaatgtaaaatgtatatgtaggttaaactctttcttagattatatcatctatatatgtttcattatt

SEQ ID NO: 119 - DNA, 1145 bp, Arabidopsis thaliana
  source 1..1145: mol_type = other DNA
gactccattattatccctctctctacaaaaaaaacagtagagagagatatagagagcatcaatggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctgatattttccggtgaaagaaacatggtagtagtatatcggttaatagcagattaaggataattaaaactaaaatgtttcctgatttaatcaggggctaagttattgttagaagattgttgttttttgaattaattctcacaattgtatcctaaattatatagtttacttaatgttgaactaataaattttgatttacaatc

SEQ ID NO: 120 - DNA, 2268 bp, Arabidopsis thaliana
  source 1..2268: mol_type = other DNA
atggcggaatcaagctctcctctccctcctctttgtgaaaggatctcacacaaaagctatttcttaagagctgtggatctcactattctaggtcttctcctttctcttctattgtaccgtatcctacatgtgaaccaaaaggacaccgtttggatcgtggctttcctctgtgaaacttgtttcaccttcgtatggttgcttattaccaacataaaatggagtcctgctgattataaaacatatcctgaaagacttgatgaaagggttcatgaacttccaccggtagatatgttcgtgaccacagctgatccagtaagggagccaccgcttatcgttgtaaacacagtgctttcactgttagctgtgaattatccggcgaacaaactagcttgttatgtgtcggacgatggatgttcacctctcacttacttctctctcaaggaagcttctaagtttgccaagatttgggttcctttctgcaagaaatacaacgttagagttagagctccttttatgtacttcagaaactctccggaagcagcagaaggttctgaattcagtaaagactgggaaatgactaagagggagtacgagaagttaagccagaaagtagaagatgccactggaagttcccactggttggatgcagaagatgactttgaagctttcttaaacacaaaatcaaatgatcattcaactatagttaaggtggtatgggaaaacaagggaggtgtgggagacgaaaaagaggtccctcatgttgtttacatttcaagagagaaaagaccaaatcactttcatcattacaaagctggagccatgaactttctggtaagagtgtcagggttgatgacaaatgcaccatacatgttgaacgtagactgcgacatgtatgtcaatgaagcagatgtggtgcgacaagcaatgtgtatatttctgcaaaaatcaatggattcaaaccattgtgcttttgttcaataccctcaagatttctatgattctaatgtcggtgaactcaccgtcttacaattatacttgggacgaggaattgcgggaatccaaggacctcagtatgcgggttcaggatgcttccatactagaagagttatgtacggtctttctctagacgatttaggagacgatggaagtctttcttcaattgctacaaggaagtatttagctgaggagagtctaacgagagaatttgggaattctaaggagatggtgaaatcggtggtcgatgcgttacaaagaaaaccatttccccaaaaaaaccttaaggactctctagaaacggctcaagaaatgggacattgtcactacgagtaccaaaccagctggggaaaaaacatcggttggttatacgattcaacaacggaagatgtgaacacgagtatcggaattcattcgagagggtggactagctcatatatttttccggatccaccggcgtttcttgggtgtatgccacaaggaggaccggaggtaatggttcagcagcgacgatgggccacgggactgctcgaaatccttttcaacaaacaaagtccgttgatcggaatgttttgtcggaaaataagatttcgacaaagcttggcttatttatacgttttcagttggggtctaagatcaatccctgagctcttttactgtctcctgcctgcttattgcctactccacaactctgctttatttcccaagggagtttacttaggtataatcatcacacttgtggggatacattgtctttacactttatgggaattcatgaaccttggtttttccatacaatcgtggtatgtcactcaatcatttgggaggataaaaacaacttgtagttggttatttagcgtccttgatgtcatactcaagcttcttggaatatcgaaaaccgtcttcatagtcactaaaaagactatgcctgagaccaagtcagggtctggatccaaaaaatctcaacgagaagttgattgtccaaaccaagattccggtaaatttgaatttgatggctcgctttatttcttgccgggcacattcattgtgttagtgaatctagccgctctagccggttgtttggtgggtctacaaagtcgcggaggaggtggttcgggtttggcagaagcctgtggctgtattttggtggttattttgttccttccatttctaaagggtatgtttgagaagggaaaatatggtatcccattttctactctttctaaagctgcctttttagcagcgttatttgttgttttatctgtgggaaactag

SEQ ID NO: 121 - DNA, 1381 bp, Arabidopsis thaliana
  source 1..1381: mol_type = other DNA
catatttatactactagtatataagttaagggtttaagcctcttctcttccttctttctcttagccatcacatcgataatggcttctcttctaacaaaacccaaacccgttttcctctgttcaccatcgttatctccaagaactttgaacacagcaacaccgtcattgaatttcaccagaatttcattcacccatcaccaaaagcttgctcctttcaagcctcctagtctcgttgttgcattctctgaaaagggtttgaagagagatgtcaccacagctgctgcagcgacggagggagattacagaaggataatgttatctgatgtgttggtgaagaagaaggaaaaagtagtttggtgggagagagaatggaaagctatggactttggagctgttgctgtcgttttgtctatgcatttgcttagtcttttggctccgtttcaattcaattggagagctgtttcggttgcttttgggctttatatcgttacaggtcttctggggattactctgtctttccataggaatctttctcataaagccttcaagctacctaaatggcttgagtacttgtttgcttattgtggagctcaagctcttcagggaaacccaattgattgggtgagtacacataggtaccatcatcagttttgtgattcagacagagaccctcatagcccacttgatgggttttggttcagtcacatgaattggatgtttgataccaatacaatcacccaaaggtgtggagagcctaataatgttggggacttggagaagcagccattctatcgattccttcgaaccacctacattttgcatccgctggctctagcggttgctttatacgcaatgggtggctttccattcatcgtttggggaatgggtgtaagaatagtatgggtatatcatataacttggctagtgaactcagcttgtcatgtatggggaaaacaagcatggaacacaggcgatttgtctaagaacaactggtgggtagcagctctagcattcggggaaggatggcacaacaatcaccatgcttttgagttctcagctcgacacggcttagaatggtggcaacttgatatgacttggtacgtcgttaagttccttcaagccatcggtttagcaactgatgtcaagctcccatcggaagctcagaaacaaagaatggcattcaccagcgactgatcttaaaaaactacatggttatgcctaaagtcaaaactgtcggttcgattgaagctatgaaggttttaaaaaaggattttgttctgcttttttgtgtttacttaaaggtatatatctgtgcaagagattgtatgtgacaaactgattatgaataatatctataattacattcaatacaaaaggaagc

SEQ ID NO: 122 - DNA, 980 bp, Arabidopsis thaliana
  source 1..980: mol_type = other DNA
aaatcactcaccacataaagtaaaagtctcatctcttcataaaatagctttaaaccaatcaagtagagtttcttctcaagtctttttattttatttttatcaatggcttcttcagcagtgtctctccaatccatctctatgacaactctcaacaatctttcatgtaatcaacaatttcatcgaagctctcttcttggttcctctaaatccttccaaaatcttggtatctcatctaacggttcagatttctcctatccatcaagtttcactgccaagaagaacctcactgcttctcgagctctctcccaaaacgggaatatcgaaaaccctagaccaagcaaagttcaagaactgagtgtgtacgaaatcaacgaattagatcgacacagccccaagattcttaaaaacgcattcagcttaatgttcggtctcggagatctcgtaccattcacaaacaaactctacacaggcgatctcaagaaacgcgtgggcatcacggcaggtctctgcgtcgtcatcgaacacgtcccagagaagaaaggtgaaagattcgaagctacttatagcttctacttcggagactatggccacttgtccgttcaaggaccatacttgacttacgaggattcgttcctcgccatcactggtggtgctggaatctttgaaggtgcctacggacaggtcaagcttcaacagcttgtgtatccgacaaaactgttctacactttttaccttaaagggttggctaatgatttgccgttggagctcaccggaacaccggtaccgccgtctaaggacatagagccggcgccggaagctaaggcactggagcctagcggagttataagtaactataccaactaattcatgaaattaaaatgtttctcgtatcgctgtgtaatgatataaagatttgtagttttgtgctcttatctgtaataaaatcattgaggaataatatctcgagtatgttttaagtc

SEQ ID NO: 123 - DNA, 2706 bp, Arabidopsis thaliana
  source 1..2706: mol_type = other DNA
ccggttacagctacaccgccgttttctctctccgccgtcttttctcttcttctccgactgaatctgtgaaggtgaatttcggagttgagaaagagagattagcgtgtaatggcgatcgataatggcaagcttcaagaagaagaagcctcatctgttactcgattctataacattattttgggttgggactataaacagcttactaaagagaatgagaggaaaaatagaaaggattctaaagagaaattgaatgttgtaaagaatacttataaagatgttgatgattatttcgagacttttgaaccattgctcttcgaggaagttaaagctcaaattttgcagaataaagatggtgaagaagcatcggtgtgtaaaatgagattggtaatggagtgcaacgagggcgaagggtttcactttctgttagtcacatacgaacatgaggaggatgaatatcttgctcaaaatgatcttttattgctatcaaaagaagaggttaaagggaattcatttccttcatcttatgggtttgctgtagtggaacatcgtcaaaataatcttcttcgtcttcggatgtatttagctgaagacattgtgcagataaccaagaatactaaatcctctagaacaaagtcatttatccaagcgctttcaaatatgcgttctcttattacatcatctgccagccctattgacaaaagggtattcagtttaaagttatgtggtttatcaaccattattcgggaatatatagcactacgatcagttagttcgctccctttcaaggatttaatcttcactgcagcagaaaaatcttgtggttttggagatgaagcatggaaaatatctggacctctgaatgaattctttaacgaaaaccttaacaaatcccaaaaggaggcaattgatgttggtctatcaagaaaatccttcgtcttaatacagggtcctccaggtaccgggaaaactcagacgattcttagcatacttggtgctattatgcatgctactcccgcaagagtccagtctaagggtacagatcatgaagtaaagcgtggtattcagatgactatccaggaaaaatacaatcactggggaagagcctctccttggattttgggtgtcaaccctcgagatgctattatgcctgaagatggtgacgatgggttctttccaacctcaggaaatgaattgaaaccggaggtggttaatgcgagtcggaagtacagattacgtgtacttgtctgtgctccatcaaactctgcacttgatgagattgtgttgcggcttctgagttcgggtcttcgtgacgaaaacgcccagacatatacacccaaaatagtacgaattggtctcaaggctcatcactctgttgcgtcagtatcactggatcaccttgtggcacaaaagcgtggctctgccatcgataagccaaaacaagggactacaggaactgatatagatagtatccgcactgcaattttggaagaggctgcgattgtgttcgctacccttagcttcagtggctctgcacttcttgctaaatctaaccgtggtttcgatgtcgttataatagatgaagctgcgcaagctgttgagccagcaactcttatccctttggccactaggtgcaaacaagtatttctggtaggggatccaaagcaactcccagctactgtaatctcaactgttgctcaggattctgggtacggtacaagcatgttcgagagacttcaaaaggctggctatccagtaaaaatgttgaagacccaataccggatgcatccagagataagaagctttccgtcaaagcaattctatgaaggggcactagaagatggatctgacattgaagctcagactactcgtgactggcataaataccggtgctttggtccattttgcttttttgatatacatgaagggaaagagtctcaacatccaggagcaactggttctcgggtaaatctagacgaggtggaatttgttcttctcatctaccacagacttgtaaccatgtacccggagctgaagtctagttctcagctagctattatatcaccgtataactaccaagtaaaaactttcaaagatcggtttaaggagatgtttggtacagaggcagaaaaagtggttgatatcaacactgttgatgggttccagggaagggagaaggatgttgcaatattttcatgcgtcagagctaacgaaaatggacaaatcggttttctctctaattctcggcggatgaatgtggggattacacgagccaagtcttcagtattggtcgttggttcagctgcaacattgaagagcgatccactttggaaaaaccttatcgaaagtgctgagcaaagaaaccgattattcaaggtttcaaagccattgaacaatttcttcagcgaagagaatctggagacgatgaaactgacagaggacatggagattcctgatgcaccgttgtatgaagacgaatctcttccggtggcaccatatggtggagatgatgactttggagatggtgatgctgatcaagacgatgtagccatggccggagaagactaaactctaaaaaccttttcgttattagttagaactttgatattacaggaagtggttgaacatctaacaatatctacacttattatttgtatggttttattttggtttacatacagtaataagaatgtctttacttgtgctacg

SEQ ID NO: 124 - DNA, 1543 bp, Arabidopsis thaliana
  source 1..1543: mol_type = other DNA
ctctttctttgtgggttctagtttgtgtgtatatatactatatgcacatacacataggaagatatgatgggttacgagcagatgaatcagatgacaatgacgacaacagcgatgatgaagaattacaataagaagggactaatcaatactccacagaagaaaatgacgaggagaagtgtgtcggctattgatggtggtgcagctgcgacggctaaagaaggagatcgccgtcagaatatcaagactcttgatcttagcggcatgtccttggcttctctctctgcctcttctatcaacttagcttcaatctccaaactcgatctctccaacaacaatattcagaaaattccggaatctctagtagcgagaatgttaaatttgtgggcattggatttgcaatccaatcagctaaaaactcttccaaactccattggatgtctttccaaacttaagtttcttaatgtctccggaaattatctccaatctctccccaaaactatagaagattgcagatcgctggaagagctgaacgccaacttcaacgagcttacaaggctcccagacgcgatagggtttgagctaacgaatctgacgaagctctccgtcaactcaaacaagcttgttctcttgccaaactccgttagctacttgacgtcgctgcgtgtgctcgacgcgcggctaaaccgccttagttccctccctgaggatcttgagaacctcgtgaaccttcaggtcctcaacgttagccagaacttccagcacttgacgacgttaccttactccgttgggttgttgatatctctcgtggagcttgatgttagttataacggaattacggttttaccagactccctcggctgtcttcgccggattcagaagctatccgtggagggtaatcccctcatttccccaccatttgaagtggtggaacaggggttggaagcattgaagcagtatatgagcgagaagatgaccgagtcttataagaaaactccgaccaagaaaaagtcttggggcattggtaagctcgtaaagtacggcctgagctcttctccggggaggagtaccggccgtgaagacgggaaggaaggcttcatcaatgtatctgattaccgccaaatcgacggaatcgcctcaccgcgacatgtgtccctcttcaacccgcgacgcctcttgtctccactctccgcgtatttctctcctcctaggtattagcttatttaggtgtgttgtctgtctttttttttttcatcttctacatacgattccataccgttttcactgttacatccatgtagtgttaaattgttaatgttcttttacgttgttttctgcatgcttggtgtgaggataaaatttaattaaattgtgtatacgtttttttttccctgtctcatagaatttttctatggcttttctcatttcgttgtattgtagttcaattttgttgaacacatttgtaaactattacatagacacttaatattttactatgtatataatgtaaaatcgcatttttgaaagtactccaccatccttctca

SEQ ID NO: 125 - DNA, 1543 bp, Arabidopsis thaliana; identical to SEQ ID NO: 124
  source 1..1543: mol_type = other DNA

SEQ ID NO: 126 - DNA, 3675 bp, Arabidopsis thaliana
  source 1..3675: mol_type = other DNA
ctttcactcttcccttctctctccccaaaataaatcagaaacctatcaacattcttcaacagccacaagtaaaatttatagacatttctgtctgaagaagaaaaagattgaatttttttgcttgttgtgggttctttaatggatccaagaacaagacttgactatgctctgtttcagctcacaccaactagaacaagatgtgatcttgtgatattctctggtggtgagaatgagaaacttgcttctgggatttttcaacctttcgttacgcatctcaagagcgttagtgatcagatttctaaaggtggatactccgttactctccgtccttcctccgttggtgttccttggtttactaaagtgacccttcagagatttgtgcgatttgtgactactccggaggttcttgagaggtctgtaacattagagaaggagattgagcagatcgaggattcgattcaagctaatgcagccgccattgccggtgaagctgaaggaaacgagttgggtggtacatggacttctcaaaagtctacggctttatcaaagacgaaaggggaaactgatggagacactgtggaagaaaattcgaaggttggtcttcagcgtgttctggagaaccgtaaagcggctttgtgcaaagagcaagcgatggcttatgctcgagctttggttgttgggtttgaacttgactacatggatgacctcttttcgtttgctgatgctttcggagcttcgcggttaagggaagcgtgtgttaactttgtggacttgtgcaagagaaagaacgaggatagaatgtgggtggaccaaatcactgctatgcaagcatttcctaggcctgaattaacgttcatgggtgactctgggatcgtactcgctggtgaagagaatgatttgttgaatgctacaaacgtaaagcatggaaactctatggatgcctcgagccagggtagctttgagactggccaagaagggagagctcaaatggcaatgccgtggccaaaccagtttcctcagtacatgcagaactttcaaggacatgggtatccgcctccttatatgtttccggggatgcaaggtcaatcaccatatttccatgggaatatgcaatggcctgtaaacatgggagatgtggagtcaaatgagaagtcttccaagaagaaaaagaagaagaagaagaataagaagaagtcgaagcaagatgaatctgccgagccaagcgataattccagtactgagaccgaatcagaagacggaaatgaaggaaagaaacaatccaggaaagtggttatccgcaacataaattatataacttcaaagaggaatggagcgaaggagagtgattcagatgagtctggagaagaagaagggtttgtggatggagattctattaagcagcaagtagaagaagccattggctcagtggagagacgtcataaatcgacttcacaccgtcagaggaaacacaaaagtcacaacggtgatgatgattcaagtaacaaggaaactaaggggaatgataattgggatgccttccagaatcttcttttgaaagacaatgattcagagccagaagaattactacgtatatcatcaactgcgttaaatatggcgtctgaagttgtgagaaagagagaaccgccttctgatgattcattcttggttgcaattggaaatgaggattggggaagagaaaccagcattgagaaattcaatgcaggtgagaatgttcggataataaggaaagggaacaactatgacgaggagatgttgaatccgggtagaagcgatgaatcaagaagctattcgcaggcagagatgtcggttcatgatgggaagctcagaaccagaaatgaggcggaagaagactggttcatacgtaaccaagctggtccagaaacagatccaagtcttgtcaaaacatttgtaggagaccatttccacttaaataagagcagtgagagagatgtcctgaccgatgactctttcatgatccattctcgtgttgagaaccaagtagaagattctcggttaaggacagaaatcatggacttagacgtttacggaaccacccaacaagaaaacagtgccccggagaacactccgcatgaaccagatgacctatacatggttcttggacgggaacaagatgttaaacctacattgttaccatggacccctgaaattgactttgagactaacactttggctcaaagaacaagcagaatcgatttgataactgccacaaaggcctctgcaggtgaacaaaccttagatggtaaagaaaagaagagtcgtggtatctccaaggggaaggatgcaaagtcaagagcatcaagtagacctgacccggcgtcaaaagccaagagacctgcttggggaagtagagctgctgtctccaagtccaaatccgagatggaggaagagagaaagaagagaatggaggaacttttaattcagaggcaaaagagaattgcggagaagagttccggtggtagtgtatcaagttctttagcgtccaagaaaactcctactgtgaccaagtcagtgaagagctcgataaagaatgagaagactcctgaagccgcgcagtcaaaggctaagccagtactgagaagttccaccattgagcgccttgctgttgctcggaccgctccaaaggagccacagcaaaaaccagtaatcaaaagaacatcaaaaccttcaggatacaagacagagaaagctcaggaaaagaaatcgagtaaaataggtcaatcagatgcgaaaagtgtggaactttctcgtgacccgagtctcgaaatcaaggaaacggtggtggaagattcacattcttacttgtcagagaagcaagttgatgcacttcctgctgttgcttctgttgatgatttcaaagacattaaagaattgcatagcttgccatcagaagaaacggccagagtaaagaacagaccgaatgaaatcatagcagagaaagtacaagatcagacgaagatcgatgatcaggaaacagtgaagaatacatctgtttctgaagataagcaaatcaccacgaagcattactcagaggatgttggagaagtccaggcttcacaggaaaaaccggtgtctccaaagaagtcggtgactttttcagagacaaacatggaggagaagtattatttctcaccagcggtctcagagattgacatctcaacgccacctgctactgaagcagatcattcgaggaagaaatggaacagtgaagagacgtctcccaaggcaacggctaaagtcttcaggaagcttcttatgttcggaaggaaaaagtaaaaccgacgttggaattcttcttctccggcatcatcgaacctttgttttgagacgacgtcatgttgagttcagagaacaatatatggggatgtgttggaatcatgaatcgtaggttaaatcctacaagaggaaaagcttcaggagacagagaagatgaagagaagagaagaaaggaagaagaagaagaagtcgtgacaaagaaagtcagctaatagacatatctccgctatttaaagtcgagtctaagcctttatacacttaaaggttgagggttcgaacccttgttatgtctttttgccctaaaagaaaaaaactttctcatgaaattccgtgagatgattcttccattctaagcatttg

SEQ ID NO: 127 - DNA, 3675 bp, Arabidopsis thaliana; identical to SEQ ID NO: 126
  source 1..3675: mol_type = other DNA

SEQ ID NO: 128 - DNA, 3727 bp, Arabidopsis thaliana
  source 1..3727: mol_type = other DNA
atatccagataattaattctctcataatatcttctccacaatttcaactcttctaaagtctaaaccatgaagttactctcaaagacctttttgatattaactctcaccttcttcttctttggcattgcactagcgaaacagagctttgaaccagagatcgaagctttgaaatccttcaagaatggtatttccaacgaccctttaggagtattatcagattggaccatcatcggttcgttacgacactgtaattggaccggaatcacctgcgatagtaccggacatgtagtctcggtttccttgctggagaagcaacttgaaggtgttctgtctccagccatagcgaatctcacctatctccaggttcttgatctcacttcaaatagttttaccggcaaaataccggctgaaataggaaagttaaccgagcttaaccagcttattctgtacctaaactatttctctggttcgattccttctggaatctgggagcttaagaatattttctatcttgatcttagaaataatttgttgtccggtgatgttcctgaggaaatctgcaaaaccagttctttggtattgattgggtttgattacaacaacttaaccgggaaaataccagaatgcttaggagatttggttcatctccaaatgtttgtagcagctggtaaccatttaactggttcgattccggtatcaattggtactctggctaatttaacggatttagacctgagtggtaaccagttaaccggaaaaataccgagagattttggaaatctcttgaacttacagtctctcgttttaactgaaaacttgttggaaggagatataccagctgagatcggaaactgctcgagcttggtccaacttgagctttacgataaccagttaaccgggaaaataccagctgaattagggaatttggttcagctgcaagcactccggatatacaagaacaaacttacttcttcaattccatcttcattgttccggttaactcagttaacccatttggggttatcagaaaaccatttggttggaccgatatcagaagaaatcggttttcttgagtcacttgaagtcctcacacttcattccaacaacttcacaggagagtttccacagtccatcacaaacttgaggaacttgacagtcctaacggtggggttcaataatatttccggtgagctcccggcggatctagggcttcttacaaaccttcggaacctttcagcgcacgacaatcttcttaccggaccaataccttccagcataagtaactgcaccggtcttaaactcctggacctgtctcacaaccaaatgactggcgagatcccgcggggtttcggaaggatgaatcttacgttcatttctattgggaggaatcatttcaccggtgaaattccagatgatatcttcaactgttcaaacttggaaactcttagtgtggcagataacaacttaacaggaactctcaagccattaattgggaagcttcaaaaactcaggattttgcaagtttcatataactctctcactggaccgattcctcgagaaatcgggaatctgaaagatttgaatatcttgtaccttcactctaatggtttcacagggagaatcccgagagagatgtcgaatctcactctcctccaggggctaaggatgtattcaaatgatcttgaaggtccaattcctgaagaaatgtttgatatgaagctactctcagttcttgatctttccaacaacaaattctcaggtcaaattcctgccttgttctccaagcttgaatcgcttacctacttgagtcttcaaggaaacaaattcaacgggtctatccctgcaagccttaagtcgctttcgcttctcaacacattcgatatctccgacaatcttctcactggaaccatccctggagagctgttagcttctttgaaaaacatgcagctttacctcaacttctcaaacaacttgttgactggaaccatcccaaaggagcttggaaagcttgaaatggttcaagaaatcgacctttcaaacaatctcttttctgggtctattccaagatctttacaggcctgcaaaaatgtgttcacactggatttttcgcagaacaatctctcgggtcatataccagatgaagtcttccaaggcatggatatgatcataagcttgaacctttcaaggaacagtttctctggagaaatccctcagagcttcgggaacatgacgcatttggtctccttggatctctctagtaacaatctcactggtgaaattccagagagtctcgccaatctttcgactctgaaacatctcaaactagcttcaaacaacctcaaaggccatgttcctgaatccggggtgttcaaaaacatcaacgcctctgatctaatgggaaacacagatctctgtggtagcaagaagcctctcaagccatgtacgatcaagcagaagtcgagccacttctcgaagagaaccagagtcatcctgattattcttggatcagccgcggctcttcttcttgtcctgcttcttgttctgattctaacctgttgcaagaaaaaagaaaaaaagattgaaaattcatcagagtcctcattaccggatttggattcagctctgaaactgaagagatttgaaccaaaagagttggagcaagcaacagattcattcaacagtgccaacatcattggctcaagcagcttaagcacagtgtacaaaggtcagctagaagatgggacagtgattgcagtaaaagtattgaatctaaaggaattctctgcagaatcagacaagtggttctacacagaagctaaaacattgagccaactaaaacatcgaaacctggtgaagatcttagggtttgcgtgggaaagcggcaaaacgaaagctttagtgcttccatttatggagaatggaaacttggaggacaccattcacggctctgcagcaccgattgggtcgcttttagaaaaaatcgatctttgtgttcatatcgcaagcggaatcgattatcttcattctggatatggttttcccatcgttcattgtgatctgaagccagctaatatactccttgacagtgaccgcgttgctcacgtaagcgattttggaactgctcggattctaggtttccgcgaagatggaagcaccacagcttcaacatcagccttcgagggtacaattggatacttagctccagagtttgcttatatgaggaaagtgacaacaaaagccgatgtattcagcttcgggatcataatgatggagctgatgacgaaacagagaccaacttcgttgaatgatgaagattcacaagacatgactttgcgccaattggtggagaaatcgattggaaatggaagaaaagggatggttagggttcttgatatggaactcggggactctattgtttctctgaaacaggaagaggctattgaagactttctgaagctttgtttgttctgtacaagctctagacctgaagatcgacctgatatgaacgagattcttacacatctgatgaaacttagaggcaaagcgaattcatttcgagaagatcgtaacgaggatcgagaagtttagcagcaaagcttttttgatgacattttttcgactttgccaaactctgttacgaaggttgaatactttggacgtaaaacgttctgattttgcttttcgttatgtatttctgttttatataaggttgaaatttggttttgat

SEQ ID NO: 129 - DNA, 1177 bp, Arabidopsis thaliana
  source 1..1177: mol_type = other DNA
caaaacaaaacgccattttttgtcgattcttcgtcgtcctcctttgaaattcacaccaatttgtctctcttcctagagaaacaaaagattattcgaaactcgggaaagtatcatccggtcaccggaaaattgattatttccgatgccaataggtgaccgtcagaatccgagtgtggagaagaagaagaacctcttcaggctatgtccgttttggcagaggagaagcaccacttcttcatcttcaacacagaatccaaaccaaaactaccgtagccgccatggaaatcggaatacagatatttccgccgtctctaagcctccgttgactatgtcttccgtcgccagatcacttcttccagctcgccgtcgtctccgactagatccttctagttatctgtatttcccttatgaacctggaaaacaagttcgcagcgcaataaagcttaagaacactagcaaatctcatactgcatttaagttccaaacaacggcacctaagagttgttatatgcgtcctcccggaggtgttttggctccaggagagagtgtttttgctactgtgttcaagtttgtggaacatccagagaacaatgaaaagcagccgttgaatcagaagagcaaggttaagtttaagattatgagcctgaaagttaaaccaggagtagagtatgtgcctgagttgtttgatgagcaaaaggatcaagtagcagtggagcaggttcttcgggtcatttttattgatgcggaccgcccaagtgctgcattggagaaactgaaacgtcaattggatgaagctgaagctgcagttgaagcaagaaagaagcctcccccagagacagggcctcgagttgtcggggagggtcttgtcatagacgaatggaaggagagaagagagaagtaccttgctcggcaacaagtcgaatccgtagattctttgtcctaaacgcagagagcaatgtggacttgttctgcagatcatgtacataatttattatccctcgattatgtatttatctctagacgattactttgtggttcttgtatgtctctgtttgttgtgtgattcatgccggttttttctccttcatcaaattttgtttcggtcgtttttagttgatctagaatcgaaccagagtttgttcagtatttagttacaaatgaaaaatcctgttatacc

SEQ ID NO: 130 - DNA, 960 bp, Arabidopsis thaliana
  source 1..960: mol_type = other DNA
tcgtcgccgttaaaatctgcgatctcattgctcattggtgaagacaaatccctaattcgtatgtcagattctgtggccggcgatttccctcccgatccacttctcgcctccggagccttcatctcctccgccggtgacggaaccctagacagtagtgcgaaacgacgaccgattcagggaggaatcggaatttctggttcgggagagagcgtacgcatcgggatggctaacggcactgatcaggtgaatcatcagacggaatcgaagtcgcggaagcgtgcggcgcctggagataattggttgcctcctggttggagagttgaagataagattcgaacttccggtgccacagctggttcggtggataagtactattacgaaccaaatacaggacgtaagtttcggtccaggactgaggtgctgtactacttggaacatggaacttctaaaagaggcaccaagaaagctgagaatacatatttcaatccagaccattttgaaggccaaggaagcaatagagtcaccagaaccgctacagtgcctccacctccgccaccgccattggactttgattttaagaatccaccagacaaggtaagctggtctatggcaaacgcaggagaagaaggttggatacctaatattggggacgtcaaggttcaagactcagtgagacgagattggagcactgcgtttacctttatcacaagccgaaaccctagtaaagtgtcggcttgaagactatgatgacctggtggcgatttttgggttgttgcatctatggtaagatacacagatatgttagggttacttaattggataattcttgtttagtcttcattcatcaatcatcaagttatgtgtactataatttttgtagcggtttttggaagaatatgataaggggatatgcatctttgtgtttgcttttggaacgtgataaccattcgacttttgact

SEQ ID NO: 131 - DNA, 1115 bp, Arabidopsis thaliana
  source 1..1115: mol_type = other DNA
tactcacttttacaactaactcataagtaaaacacagacagtttttagatggctaagatatattccccttcttttcccggtactctctgtctttgcatttttactctcttgacgctaatgttcattcgggtttccgctcgacccgcgacattcgtcgaggatttcaaagccgcctggtcggaatctcacatccgtcaaatggaagacggaaaagctatccagctcgtccttgatcagagcactggatgtggatttgcttccaaaagaaaatatctattcggacgagtgagcatgaagatcaaactcattcccggagactctgccggtacggtcaccgctttctacatgaactccgatacggccacggtgagagacgagctagattttgagttcttgggaaacagaagtggtcaaccttactcagtgcaaacaaacatatttgctcatggcaaaggagatagagaacaaagagttaatctttggttcgacccatctatggattaccacacttacactatcttatggtcacacaaacacattgttttttacgtagacgatgtgccaataagagaatacaaaaacaacgaagccaagaacatagcttacccaacatcacaacctatgggagtatactcaacattatgggaagcagatgactgggcaacacgtggtggattagagaaaattgattggagcaaagctccattttatgcttattacaaagatttcgacatcgaaggttgtcctgttcctggaccaaccttttgtccatcgaaccctcataattggtgggaaggttatgcctatcagtctcttaacgccgttgaagctcgacgttaccggtgggttagagtaaaccatatggtttatgattattgtactgaccggtctaggtttcctgtcccaccacccgagtgtcgtgcttgaaaataattgcatacgtacgttgcaatgatcatgtttcgtcttgtacgagattttatatataaattgtgggaaaatgtggattgtattgtcctcttacgcaattgtgcagacgtacgtgagtgtgtatagatataattgtgatttgtggttatttgaaatttttataaacatagatgaattctgtgaag

SEQ ID NO: 132 - DNA, 1981 bp, Arabidopsis thaliana
  source 1..1981: mol_type = other DNA
actggtgtgcgcactaagcaagcatactctattatttgtcgaaatcacaagagccagccagtctctctgagttctatcacaatcttcttcttcagagcttattgagtaatggcggcttcaatgcagttctacggagttaaaacaccagaacttgccttaaactcaaaaaggattgagtttagctcaaaggggctcaacttctcagcactcgtgtcctctgctcgtgtattctctagaaacgtagatcgttcttgtaagaacatcgctctgagagttacttgtgaagcgggaagagtggagctgctagagagaaaagcctcagagactttcaagttaaacaaaactgagaaaaaattgacctgtgtaatgaaattcggtggctcatcagtggcatcagcagaaaggatgatacaagttgccaaactcatactcagcttcccagatgagaagcctgttgttgtgctatcagcaatggcaaagaccaccaataagcttttgatggctggggagaaggctgtttgctgcggtgtcaccaacgtcgacactatcgaagagttgagctatataaaggaactccatataaggactgctcatgagcttggagtggaaacagcagttattgcagaacatctagaaggactggaacagcttcttaaaggcgtcgcaatgatgaaggaattaactttacgctcaagagactacttggtttcatttggagaatgcatgtccactaggctatttgctgcgtacctgaacaaaattgggcacaaagcacgacagtatgatgcatttgagatcgggattatcaccacagatgacttcactaatgctgatattcttgaggcaacatacccggcggtttcgaaaaagttacttggtgactggagcaaggaaaatgcactccccgttgtcacaggcttccttggaaagggatggagatcttgtgctgtaactacgcttggtagaggaggtagcgatttgactgcaacaacgatcgggaaggctttaggtttgcgggagatccaggtttggaaagatgtggatggagttttgacttgtgatcctaacatttactgcggagctcaacctgttccacacttgacatttgatgaggctgctgaacttgcttactttggtgcccaggtgttgcatccactttccatgcgcccagcgcgagaaggtaacattcctgtaagggttaagaactcttacaatcccactgctccaggaactgtcatcaccagatcaagagacatgagcaaggctgtattgaccagcatcgttctgaaacgtaatgtcaccatgttggacatcactagcacccgtatgctcggccaatatggtttccttgccaaggtgttttccacatttgaaaagttgggcatatctgtggatgttgttgcaaccagcgaagttagcatttctttgacattggatccttcaaagttctgtagcagagagttaattcaacacgagcttgatcaggtggtggaggaacttgagaagattgctgttgtaaatctgcttcgacacagatcaattatctctctcatcggaaatgttcagagatcatcattcatattagagaagggcttccgagtacttcgaaccaatgggattaatgtccagatgatctcccaaggtgcatctaaggtaaacatctcactgatagtgaatgatgatgaggcggagcattgtgtgaaggctctccactcggccttctttgagacagacacttgtgaagcagtctcagaatgcccgaccggctacatcgctgcctcttcgtgaaacctctaggtgcaacctgcaaggtctgaaagtactagctagtttgatgttatgattcttgtcagactggtattaggaaacaaagctcccattctccttgtgtaatataatgtaatttgattgggagatgtactggaaaatcaataagttttcctatttgaatatatgattaggactgcctacaacatcagtt

SEQ ID NO: 133 - DNA, 3043 bp, Arabidopsis thaliana
  source 1..3043: mol_type = other DNA
atgagatctcttctctttgtactatcactcatttgcttttgctctcaaacagcactttcatggaagaaggaagagtttcgcagctgtgaccaaactccattttgtaaacgcgctcgatctcgtactcccggcgcgtgttctctaattgtcggcgatgtttccatcactgatggagatctcgtagcgaagcttctaccgaaagcgcctaatcaaggcgatggggatcagatcaagccgttgattctttctctctcagtttacaaggatgggatcgtgcggcttaaaatcgatgaggaccattcgttgaacccgccgaagaagaggttccaagttcctgatgtggtagtgtctgagtttgaggagaagaagatctggctgcagaaagtagcgacggagacgatctctggagacactagtccgtcttcagtagtttatgtatccgatggttacgaggcggtggtgcgacacgatccgtttgaggtgtatgtgcgtgagaaatcaggtgatcgccgtcgcgttgtgtcattgaattctcatggattatttgattttgagcagttggggaggaaaactgaaggagataactgggaagagaaatttaggactcatacagattctagaccatctggtcctcaatctattagtttcgatgtttcgttttatgattccagtttcgtttatggaattcctgaacacgccactagcttcgcgttgaagcctaccaagggtcctggagttgaggaatctgaaccctacaggctttttaatctagatgtgtttgaatacgatcatgaatcaccgtttgggctttacgggtcgattccgttcatggtttcgcatgggaagtctggtaaaacttcaggatttttctggttgaatgctgcggaaatgcagattgatgtgttggctaatggttgggatgcagagagtggtatttctttgccttctagtcacagtaggatcgacacattctggatgagcgaggcagggattgtggatacattctttttcgttgggcctgagccaaaggatgttgtaaagcagtatgcaagtgtgacaggtacttcagccatgcctcagttgtttgccactggttatcatcaatgtaggtggaactacaaagatgaggaggatgtggcacaggtggactcgaaattcgatgaacacgatattccttatgatgttctctggcttgacattgagcatacagatgggaagagatactttacatgggatagtgtgttgtttcctcatccagaggagatgcaaaagaaattggctgcaaagggtaggaagatggtgaccattgtggatcctcatatcaagagggatgactcatacttcttacacaaagaggctactcagatgggatactatgttaaggattcatctggaaaagactttgatggttggtgctggcctggttcatcatcttacattgatatgttgagcccagagattagaaaatggtggggtgggaggttctcgtataagaactatgttggttcaactccatcattgtacacctggaatgacatgaatgagccttctgtattcaatggtcccgaggttactatgccaagagatgcattacatgttgggggtgttgaacacagagaagttcataacgcatatggatattacttccacatggcgacttccgatggacttgttatgcgtgaagaaggaaaggataggccttttgtattgtcaagagcaatctttcccggcactcaaagatacggagcaatttggactggagataacacagccgaatgggaacaccttagagtctccattccaatgatattgacacttggtcttactggaattacattctctggagctgatattggtgggttttttggaaatcctgaaccagaacttctagttaggtggtaccaagtgggtgcttactatccatttttcaggggtcatgctcatcacgataccaaaagacgagagccttggttgtttggtgaacggaacacagaactcatgagagatgccatacacactcgttacacactgctcccatacttctacacgttgttcagagaagcaaacgttacgggtgttcctgttgtacgcccattatggatggaattcccgcaagatgaagctacttttagcaacgatgaagccttcatggtcggtagtggtctactggttcaaggagtttacaccaagggaacaacgcaagcttccgtgtatttgcctggcaaagaatcatggtatgacttgagaaacggtaagacttacgttggaggcaagactcacaagatggatgctccagaggagagtattcctgcgtttcaaaaggcaggaaccatcatcccaaggaaggaccggtttaggcgaagttcctctcaaatggacaatgatccttatactttggtggtagctttgaacagttctcaagaagcagaaggtgaactctacatcgatgacggcaaaagctttgaattcagacgaggctcttacatccatcgtcgcttcgtcttctcaaagggtgttcttacatcaacgaacttagctcctccagaagctcgtctctcttcccaatgcttgatcgacagaattatcctcttgggacacagctcaggtccaaaatctgcgttggtggaaccgttgaatcaaaaggcagagattgagatgggacctctgcgaatgggtgggcttgtagcttcctcgggtacaaaggtgttgactatccgcaaaccgggtgttcgagtggaccaagactggaccgtaaagattctgtgattgaacggtttgaaccagtttcactcatggccgttagagtggccgaaatctgcttttccggcgacggaatatcacactttttaatatatgtttggagatttagacttaaatagttgtaagagctaacagtttgaaagtcactttgcattgttgtttatcttcatataaatgagtttagattttgataatttcagaattcgtggaatcataattaacaattttgatagggaaaaataatttgttttttttagtcagagggtcaaataatcttaccttc

SEQ ID NO: 134 - DNA, 787 bp, Arabidopsis thaliana
  source 1..787: mol_type = other DNA
attttttctagggtttcctcttccgcattcgtcgtcttcagctcctcctacacagtttcttctctgaatctacttaggaagctaaaatgggtagatgtccgactagaaaagtgaagaagaggagattatctcacaaaacagctcgccgtgacaaattcgaagtcaaaggcgatgacttggtttacacagagttgcgtaaaccggagacggagattaagccgttacagcttgacgaggatttgcctggaatgggtcaattctactgcttacactgcgatcgatacttctccaacgtatcagtgagggatgatcatttcaagactaagaaacacaagaagcgtgtgaatatgatgatgggacaagcgccacactcgcaactcgatgcagatttagccgggggaatggggatgccggacaatggcccaaagctgatgtctaatttggtattcacagagttgcgtaaaccagagacggaggatttacctggaatgggtcaattcaactgcttactctgccatcggaacttctccaatgcatcagtgatggattatcatttcaagactaagaaacacaaaaagcgtgtgaagaagatagagcgaccagcgccacactcgcaactcgatgcagatttagctggtggaatgggaatgccagacaatggtccaaagctgatgtctgcctgagtttttacagttattttccttatttagttaatggaacccgaaattttgttgtaaaactataatctcctaaattaatgatacaggttttttgtctgttgccaagt

SEQ ID NO: 135 - DNA, 1397 bp, Arabidopsis thaliana
  source 1..1397: mol_type = other DNA
aaaataatggcttcgcccgggttcgaaccggagaccttcagtgtgttagactgacgtgataaccaactacaccacgaaacctacatgcttctttctaacctcaacaatatatatatacatatagataactgtttaatattgtaacttgtaaccagtgtcggctaatttcgacttttgtagatctttttctgctctttctctctctctctctctctctctctctctctctctctctcttgtattatttctatctcccccgccgtcgaaagagaaacgtcgatcggagaacctttgaaatgtcgactggattagatatgtctctcgacgacatgatcgccaagaaccgtaagtctcgtggtggagccggccccgctcgtggaaccggatccggatccggaccgggtccgactcgccgcaacaaccctaatcggaaatcaacccgatctgctccataccaatcagccaaggcgccggagtccacctggggtcacgacatgttctccgatagatctgaagatcaccgatcgggacgttcctccgccggaatcgaaactggaaccaagctctacatttccaatttggattacggtgtcatgaacgaagacatcaaggaactgtttgctgaagttggagaacttaaacgctacacagttcattttgatagaagtggaagatcaaagggaactgctgaagtagtgtattctcggcgtggcgatgcactcgcagctgtgaagaagtataatgatgttcagctggatggaaaacccatgaagatagagattgtgggcactaatcttcaaactgctgcagccccgtctggtagacctgcgaatggaaactccaatggtgctccatggagcagaggaggacaagggagaggaggtcaacaacgaggtggtggacgaggaggcggtggccgaggtggtggtggtcgtggtaggcgtcctggtaagggccctgcagagaagatttctgcggaagatcttgatgcggatcttgataagtaccattctggagatatggagacaaactaaggaacgtgactgatcttctcaaaccggtaggggttttaggaggaagagaatcgagaaaatgtttgccagaggctttaccacttagcgcctttttggctgtgttgttcatttgtttcattagaatgactttacagaattgagaatatgtgttatttaaagttgttgtctatcttaataccctcaagtgaaaggcagaggaaggaataccaatttcgtttacagatcatatgcaggcaaaagagttttcagaaatcaggtttagttacttgtattgtgtctcttatccaagccatgccttgtggtattatgagcgcagaattttgattgaatattgttcatttgcattaaagtatcaaaccattt

SEQ ID NO: 136 - DNA, 636 bp, Arabidopsis thaliana
  source 1..636: mol_type = other DNA
aaaactcctccgtaaaaccctttcatttgcatttgggaatcgattgctcttcttcgtagtcgcctttgaattcgcagagtgagaagcaatgaaggtgagatcatctgtgaagaagatgtgtgagttttgtaaaacagtgaaacgtcgtggacgtgtgtatgttatatgctcttccaatcctaagcacaagcaaagacaagggttcagttcctttgcttatgaaggaattacaccttcccctttgtttgctgagccgattgctagtcaggagttggtgaggctgcctggtcagggggtatcagccggactggcatcacttttacacaaaaggcctatgccaacagcgtatttcggatggaggtctggtcttgcatccattctcttcaaacaaggaaattaggatgtcagcatttccctttttattcttcagatttgtaatcgcagttttcttccaattcctatgaaacattattgtatatctctccacttttactttggtcagtcgtatgctccttcgagacctgtttgattgtgcctcgcatgacctgaacaaagagatatattatgacactcgagtatttgtttttacattttccactggagcatatgttagggatcaatatgtttttcttttag

SEQ ID NO: 137 - DNA, 666 bp, Arabidopsis thaliana
  source 1..666: mol_type = other DNA
tgctcttcttcgtagtcgcctttgaattcgcagttagagatggatgcttcagattcgttttacttttgcttccatcatcggatcaactaaggattgcagtttttctgagtgagaagcaatgaaggtgagatcatctgtgaagaagatgtgtgagttttgtaaaacagtgaaacgtcgtggacgtgtgtatgttatatgctcttccaatcctaagcacaagcaaagacaagggttcagttcctttgcttatgaaggaattacaccttcccctttgtttgctgagccgattgctagtcaggagttggtgaggctgcctggtcagggggtatcagccggactggcatcacttttacacaaaaggcctatgccaacagcgtatttcggatggaggtctggtcttgcatccattctcttcaaacaaggaaattaggatgtcagcatttccctttttattcttcagatttgtaatcgcagttttcttccaattcctatgaaacattattgtatatctctccacttttactttggtcagtcgtatgctccttcgagacctgtttgattgtgcctcgcatgacctgaacaaagagatatattatgacactcgagtatttgtttttacattttccactggagcatatgttagggatcaatatgtttttcttttag

SEQ ID NO: 138 - DNA, 1991 bp, Arabidopsis thaliana
  source 1..1991: mol_type = other DNA
attccttgcttcatttttcgtcaccctagccgctttactctcttgcgatatctctgaggtaattctggagcagcataaacaatcaattgattcattcttcttgataccaagttgtggaaactctaggattgtttgctgtatatctccagaattgctgttttgattgaatttaggtcgcttagctcagttgatagagcaccacattttttgtggtagaaatcgatttgtttgacagtctctaaccatgggtaaagagaagtttcacatcaacattgtggtcattggccacgtcgattctggaaagtcgaccaccactggacacttgatctacaagttgggtggtattgacaagcgtgtcattgagaggttcgagaaggaggctgctgagatgaacaagaggtccttcaagtacgcatgggttttggacaaacttaaggctgagcgtgagcgtggtatcaccattgacattgctctctggaagttcgagaccaccaagtactactgcactgtcattgatgctcctggccatcgtgatttcatcaagaacatgatcactggtacctcccaggctgattgtgctgtccttatcattgactccaccactggtggttttgaggctggtatctccaaggatggtcagacccgtgagcacgctctacttgctttcacccttggtgtcaagcagatgatctgctgttgtaacaagatggatgccactacccccaagtactccaaggccaggtacgatgaaatcatcaaggaggtgtcttcctacttgaagaaggttggttacaaccccgacaaaatcccatttgtgcccatctctggatttgagggtgacaacatgattgagaggtccaccaaccttgactggtacaagggaccaactctccttgaggctcttgaccagatcaacgagcccaagaggccgtcagacaagccccttcgtctcccacttcaggatgtctacaagattggtggtattggaacggtgccagtgggacgtgttgagactggtatgatcaagcctggtatggttgtgacctttgctcccacaggattgaccactgaggtcaagtctgttgagatgcaccacgagtctcttcttgaggcacttccaggtgacaacgttgggttcaatgttaagaatgttgctgtcaaggatcttaagagagggtacgtcgcatccaactccaaggatgaccctgccaagggtgctgctaacttcacctcccaggtcatcatcatgaaccaccctggtcagattggtaacggttacgccccagtcctggattgccacacctctcacattgcagtcaagttctctgagatcttgaccaagattgacaggcgttctggtaaggagattgagaaggagcctaaattcttgaagaatggtgatgctggtatggtgaagatgactccaaccaagcccatggttgtggagaccttctctgagtacccaccacttggacgtttcgctgtgagggacatgaggcagactgttgcagtcggtgttatcaagagtgttgacaagaaggacccaactggagccaaggttaccaaggctgcagtcaagaagggtgccaagtgaactctgaacatcaaaactctttccgctgatgaaatgaaggactattttagtttctttactttagtagtttggtatttggttggttgtttgtgttaccgcttcgtttattctccgtcggagctcaattctcggaattgggttcttgatcggaggtggcggaggtacttggcactcgagcttcctgtttatttcttttgttttgtgttatgattttgaacctttttggatattcggttatatgatatttgtgtcattcctgcggatattatcttatcttatcaacttaagtctgtttttcttctctaaaattcaacgatcagcctctgaagtttcttacatggtaaaattgtaatctagaactttaaacaacattggagaaacaagtctatatcagttt

SEQ ID NO: 139 - DNA, 1408 bp, Arabidopsis thaliana
  source 1..1408: mol_type = other DNA
tcatgatccttaatcttagctcctagggtttctgtgaattagtctaattttacaattttatgcctttgaggatatatcttaatgtgaaagttttaaacttgtaactcaaaaaccatttgttagttagtaatcatcatcattctgaattgagctttgtttgaatttgagtagggcaacgaaagattcaagttagttgcggtggtaagagtgaggtgttgaagagtgatacaatggaacctcatgaagcagaaacgtttgtgaacaagagaaccctttatgctcccattgagccatatagcagtggaaatttaaaggtttcagatgttcacactctctactgggagcaatcaggcaaacccgatggacacccggttgtttttcttcacggcgggccgggaggagggacggctcctagtaataggagattcttcgatccggagttttatcggattgttctgtttgatcagagaggtgcggggaagagtacaccgcatgcttgtttggaggaaaacaccacatgggaccttgtgaatgatattgaaaaactaagagaacatttgaaaatacctgaatggctggtttttggaggatcatggggaagcactctagctcttgcatacagtcagtctcaccctgacaaggttactggtttggtccttagagggatctttttgttgcgtaaaaaggagattgactggttttacgagggcggtgctgctgctatttaccctgatgcttgggaggagttcagagatcttattccagaaaacgagagaggtagtagccttgtggacgcgtatcacaaaagattgaattctgatgatctggaaattcaatacgcagctgcaagagcttggactaaatgggaaatgatgactgcttatcttcgtccaaatcttgaaaacgttcaaaaggcagaggatgataaattttcattggcgtttgcaaggattgaaaatcactactttgttaacaaaggtttcttcccgtcggactcacacttgctagacaatgttgataaaatacgacatatcaagaccaccattgttcagggaaggtatgacgtatgctgtcctatgatgtctgcttgggatctgcacaaagcatggccagaggcagaactcaagattgtttatgatgctgggcactcggcaaatgagccaggaatatcagcggaactcgtggttgccaatgaaaagatgaaagcacttatgggatgaagtatttgatggaatgaaagctgctcattttgttcatttctttgggacctttgttcatattttcaagtttgttgctgcaaagtaaatatcacattcagagttagttgttaacgcgaaaccgaatgttatttccatggacgtttatacccaaatgaaaaagacaatgacataggtgcagtgttttgaaa

SEQ ID NO: 140 - DNA, 1213 bp, Arabidopsis thaliana
  source 1..1213: mol_type = other DNA
acagagttcagaatatcgacggcgacaatttctctctccggctaacttttttctagagaaagctatggcggacgaagaagatgagttactggagacagaactaagttacgaccagaaaaaggaaatcgccaagtggtttttcctcaacgctcccgctggagaaatcaattacgtcgctaaagatttaaaggcggttttgagcgatgaggaagtgtacaatgaagcagccatggaagcatttccagtgtacaacaaaactcacatgatttgccttgaaatgcccagtggagctggtgatgtgattgtctcatcttacagtgaaattaatgaaaatgagtaccttgatccaagaactgcccaggttgccatagttgatcatgttaaacagatttgtacaaaggtacggcctgcaaatgatgaagaacttccttctttgtatattgaggagtacagatatgctcttgatgctgaaatccagagatatgttagtgaatcttatccgaaaggtatgtctgcagttaattgtgtgaaagggaaagataatgagggtccagggtccgactttgagcttgttgttataattactgctatgagacttagtccccagaacttctgtaatggaagttggagatctgtatggaacatagatttccaggatgaatcccaggtgcttgacataaaagggaaattgcaggtaggagctcattattttgaagagggaaatgtggaattagatgcaaaaaaagatttccaagattcaacaatatttcagtctgcagatgactgcgcgattgccatagccaatattatcaggcaccatgaaacagagtaccttgcatctctagaggtagcttattcaaaattaccggataacactttcaaggatttgaggaggaaacttccggtgacacgaactctgttcccatggcagaacactttacagttcagcctaacaagagaggtcgagaaagaacttggacttggcaagataagtattatttctgttgtgtcttgtctttcctttggagtaatgtatacaaatcgcattagtaagtatgatagatattgttccgcaagccgcatgaaagaattgaagtttggtcccaaaaagagctccgttgccgggaatcgaacccgggtctcctgggtgaaagccagatatcctaaccgctggacgacaacggatatgttattggaactgttaaagaactaa

SEQ ID NO: 141 - DNA, 2160 bp, Arabidopsis thaliana
  source 1..2160: mol_type = other DNA
ctcgtctccttctccacttggatctcaaaagtccgatccaaaaccaaatccgccataactctctctctctctcccacttcccacagagagacacattcatgccagcaatgccaggtctcgtctcagtcaaaactccttccgatacaccgccgctacgtgtagccgtaccagacacgcaacctctctcaaacccgccgcgaactccgatgaagaaaaccccttcctctacaccatctcgatccaaaccatcaccaaatagatccaccggcaaaaaagattccccaaccgtatcctcctccaccgcagccgtaatcgacgtcgacgatccatctctagataatccagatctcggtcctttccttctaaaattagctcgtgacgctattgcttctggtgaaggtcctaacaaagcattagattacgcgatccgagcaactaagtcctttgagagatgttgcgccgccgttgctccgcctattcccggtggtagcgatggtggacctgttcttgatctcgctatgagccttcatgttctcgctgctatttactgtagtctcggccgatttgatgaagctgtaccacctcttgaacgagctattcaagtccctgatccgactcgtggccctgaccactctctcgctgcgttttctggtcatatgcaacttggtgatacgttgtctatgcttggtcagattgatagatctattgcttgttatgaagaaggtcttaagatccagatccagactttgggtgatactgatccacgagttggtgaaacttgcaggtacttagcagaagcatatgttcaagcaatgcagttcaataaagcggaagagttatgcaagaagactctagagattcaccgagcgcatagtgaacctgcttcactggaggaagcagctgataggagattgatggcaattatctgcgaggctaaaggagattatgaaaacgctcttgagcatcttgttcttgctagtatggctatgattgcgagtggacaagaatctgaggttgcatcgattgatgttagtattgggaatatttacatgtcgctgtgccggtttgatgaagctgtgttttcatatcagaaggctcttactgtgtttaaggcttctaaaggagagactcatccgacggttgcgtcagtgtttgttagattggctgagctttaccatagaacagggaaacttcgtgagtctaagtcttactgtgagaatgcgttgaggatatacaataagccggtgcctgggacaactgtggaggagattgctggtggattaactgagatttctgctatttatgagtctgtagatgaacctgaggaagcattgaagctacttcagaagtctatgaaattgcttgaggataagccaggacagcagagcgccattgcagggttagaggcacggatgggagttatgtattacacagtggggaggtacgaggacgcaagaaacgcgtttgagagcgctgtgacaaagctacgggcagcaggtgagaaatctgccttcttcggtgttgtattaaaccagatgggactagcctgcgttcagcttttcaagattgatgaagcgggtgagctgtttgaagaagcaagaggtattcttgaacaagaacgtggaccgtgcgatcaggacactctcggtgtttatagcaatctagctgctacctatgacgctatgggaaggatagaggatgcgattgagatattagagcaggttctgaagctgagagaggaaaagctcgggactgcgaatccggattttgaagacgagaagaaacgtttggccgagcttttgaaggaagctgggcggtcgcggaactacaaagccaagtcgctccagaatctgattgatccaaatgcaagacctccgaagaaagagtcttctgctaagaaatggcccagcctcggtttcaagttctgaggaaaaaattatcatataaaataaatcatccacatatatattcaatattttattttattgttattgttatattttttatctgatctattttctgtatcataatctgaggttgatgaattaatttcatgtatagtgtttttatttgagtttggtgaaatactgccaagatggtgagctgtttgtttgagtttgaaatttctttaattcaatcacttttttcttcttctgataa

SEQ ID NO: 142 - DNA, 2248 bp, Arabidopsis thaliana
  source 1..2248: mol_type = other DNA
ctcgtctccttctccacttggatctcaaaagtccgatccaaaaccaaatccgccataactctctctctctctcccacttcccacagagagacacattcatgccagcaatgccaggtctcgtctcagtcaaaactccttccgatacaccgccgctacgtgtagccgtaccagacacgcaacctctctcaaacccgccgcgaactccgatgaagaaaaccccttcctctacaccatctcgatccaaaccatcaccaaatagatccaccggcaaaaaagattccccaaccgtatcctcctccaccgcagccgtaatcgacgtcgacgatccatctctagataatccagatctcggtcctttccttctaaaattagctcgtgacgctattgcttctggtgaaggtcctaacaaagcattagattacgcgatccgagcaactaagtcctttgagagatgttgcgccgccgttgctccgcctattcccggtggtagcgatggtggacctgttcttgatctcgctatgagccttcatgttctcgctgctatttactgtagtctcggccgatttgatgaagctgtaccacctcttgaacgagctattcaagtccctgatccgactcgtggccctgaccactctctcgctgcgttttctggtcatatgcaacttggtgatacgttgtctatgcttggtcagattgatagatctattgcttgttatgaagaaggtcttaagatccagatccagactttgggtgatactgatccacgagttggtgaaacttgcaggtacttagcagaagcatatgttcaagcaatgcagttcaataaagcggaagagttatgcaagaagactctagagattcaccgagcgcatagtgaacctgcttcactggaggaagcagctgataggagattgatggcaattatctgcgaggctaaaggagattatgaaaacgctcttgagcatcttgttcttgctagtatggctatgattgcgagtggacaagaatctgaggttgcatcgattgatgttagtattgggaatatttacatgtcgctgtgccggtttgatgaagctgtgttttcatatcagaaggctcttactgtgtttaaggcttctaaaggagagactcatccgacggttgcgtcagtgtttgttagattggctgagctttaccatagaacagggaaacttcgtgagtctaagtcttactgtgagaatgcgttgaggatatacaataagccggtgcctgggacaactgtggaggagattgctggtggattaactgagatttctgctatttatgagtctgtagatgaacctgaggaagcattgaagctacttcagaagtctatgaaattgcttgaggataagccaggacagcagagcgccattgcagggttagaggcacggatgggagttatgtattacacagtggggaggtacgaggacgcaagaaacgcgtttgagagcgctgtgacaaagctacgggcagcaggtgagaaatctgccttcttcggtgttgtattaaaccagatgggactagcctgcgttcagcttttcaagattgatgaagcgggtgagctgtttgaagaagcaagaggtattcttgaacaagaacgtggaccgtgcgatcaggacactctcggtgtttatagcaatctagctgctacctatgacgctatgggaaggtaaagtcctaaagaaaactatctgactatgtaattagatcagacatccttaatgaaacattaaagtctttcttcgtgatggctatgtaatttgcaggatagaggatgcgattgagatattagagcaggttctgaagctgagagaggaaaagctcgggactgcgaatccggattttgaagacgagaagaaacgtttggccgagcttttgaaggaagctgggcggtcgcggaactacaaagccaagtcgctccagaatctgattgatccaaatgcaagacctccgaagaaagagtcttctgctaagaaatggcccagcctcggtttcaagttctgaggaaaaaattatcatataaaataaatcatccacatatatattcaatattttattttattgttattgttatattttttatctgatctattttctgtatcataatctgaggttgatgaattaatttcatgtatagtgtttttatttgagtttggtgaaatactgccaagatggtgagctgtttgtttgagtttgaaatttctttaattcaatcacttttttcttc

SEQ ID NO: 143 - DNA, 1337 bp, Arabidopsis thaliana
  source 1..1337: mol_type = other DNA
ttaaagtaatgacttttttttatatgatatattctcaattttgttactcggaaacaatagaaaggataacgaatcgtttctcttcgatcgaaagaatatatatttggaagttttctctgcttttttgttttcgtttgatagaatgggaacagttctcgattcgcattttctggctctcactgctattgtcactgtgatttaccagttcatattcttcgtaatcacggctcttttcaaatttgatcaagtcactgactttgctggtagcacaaacttcgttatacttgctgtgttaacacttgttctcaaagcctcttggcattttcgacagatagtattgactttgctagttgtggtatggggtcttcgcttggggattttccttctaatgaggatcttgcaatggggggaagatcgtcgctttgatgaacagcgtggaaatatagtgagactaatcattttctggactcttcaggctgtgtgggtttggacggttagcttacctttaacacttgttaatgcaagtgatggtggtggatctcttaaacccgcagatgttatcggttggactatgtgggttttcggtttcttgattgaagctgcagctgatcaacagaagctatcattcaaaaactctcctgaaaacagaggaaaatggtgtgatgttggagtctggaagtattcaagacatccaaactacttcggtgagatgttactgtggtggggaatctttgtggctgcatcgcctgtgcttgaaggtgcagagtatcttgtcatattcggaccactctttctcactttgctacttctattcgtcagcggcataccattactcgaggcatcggctgacaaaaaacatggaaactcaggagcttacagatcctacaagaagacaacaagtcctctgattctgttcccaagaggagtgtatgggaacttaccaggatggttcaagacggtctttctcttcgagtttccattttacagccgaaatctccctcaagagggtagactccaaaacagcaaagagaaagaagtaaaagatgactgatttgtgatactcatatttgagttattgttcttcacaacactctttgataaaatttgtgtaaaaaattgcccgtaagaaactgaatttgtttgaaatattggacagtcttgacagattatctcagttgtatttggttcttttttttatgtgattttgttttttggttaaaaaaagttcccattccaagaatcgaacccgggtctcctgggtgaaagccaaatatcctaaccgctggacgacatcggatttgattatttgattatttaattactttatatgttgattt

SEQ ID NO: 144 - DNA, 1079 bp, Arabidopsis thaliana
  source 1..1079: mol_type = other DNA
gaagagtaagagtaaaaaacaaaaccttcgtctctaacaaatgtgtggcagctgattgaaactagtagtggtgaaggagaaggagaatgggagatctctacgctttggacttcgatggagttctctgtgatagttgtggagaaagctctctatctgctgttaaggcagccaaagtgagatggcctgatttgttcgaaggagttgattccgctttagaggaatggatcgtcgatcaaatgcatattgtgagacctgtggttgaaactggctatgaaaatcttctacttgtgcggctgttattggagaccaagataccgtctattcgaaaatcttcagttgcagaggggttgacggttgatgggatactggagagctgggcaaagtttaagcccgtgatcatggaagcttgggatgaagatagagatgctttggtagatttgtttggaaaagttagagatgattggattaacaaggacttgacaacttggattggtgccaatagattctacccaggagtttcagatgcactgaaatttgccagctcaaagatttatatcgttaccacgaaacagggccgctttgcagaagcgttactgcgtgaaatagcaggtgtaatcataccatcagaaaggatttatggtttgggttcagggccaaaggtggaagttctaaagctacttcaagataaaccagaacatcagggcttgacgctgcatttcgtggaagacagactcgcaacgctgaaaaatgtcataaaagagcctgaattagacaaatggagtttatacctaggaacctggggatacaacactgagaaagagagagctgaagcagcaggcattcccaggattcaggttattgagctctccacgtttagcaataagcttaaatgagtgcatatactcattggaaaagaaacaaagctttcctctttattgtattctacggcattcaacggaaactaaaaaccaaacatgtttaggtaagattcagtaaaagagttgaactttcagtactacccattatagaagcttttctgtgacctataattcatccttagtaagatcattcttgttacc

SEQ ID NO: 145 - DNA, 1064 bp, Arabidopsis thaliana
  source 1..1064: mol_type = other DNA
gaagagtaagagtaaaaaacaaaaccttcgtctctaacaaatgtgtggcagctgattgaaactagtagtggtgaaggagaaggagaatgggagatctctacgctttggacttcgatggagttctctgtgatagttgtggagaaagctctctatctgctgttaaggcagccaaagtgagatggcctgatttgttcgaaggagttgattccgctttagaggaatggatcgtcgatcaaatgcatattgtgagacctgtggttgaaactggctatgaaaatcttctacttgtgcggctgttattggagaccaagataccgtctattcgaaaatcttcagttgcagaggggttgacggttgatgggatactggagagctgggcaaagtttaagcccgtgatcatggaagcttgggatgaagatagagatgctttggtagatttgtttggaaaagttagagatgattggattaacaaggacttgacaacttggattggtgccaatagattctacccaggagtttcagatgcactgaaatttgccagctcaaagatttatatcgttaccacgaaacagggccgctttgcagaagcgttactgcgtgaaatagcaggtgtaatcataccatcagaaaggatttatggtttgggttcagggccaaaggtggaagttctaaagctacttcaagataaaccagaacatcagggcttgacgctgcaactcgcaacgctgaaaaatgtcataaaagagcctgaattagacaaatggagtttatacctaggaacctggggatacaacactgagaaagagagagctgaagcagcaggcattcccaggattcaggttattgagctctccacgtttagcaataagcttaaatgagtgcatatactcattggaaaagaaacaaagctttcctctttattgtattctacggcattcaacggaaactaaaaaccaaacatgtttaggtaagattcagtaaaagagttgaactttcagtactacccattatagaagcttttctgtgacctataattcatccttagtaagatcattcttgttacc

SEQ ID NO: 146 - DNA, 1133 bp, Arabidopsis thaliana
  source 1..1133: mol_type = other DNA
gcagctgattgaaactagtagtggtgaaggagaaggagaatgggagatctctacgctttggacttcgatggagttctctgtgatagttgtggagaaagctctctatctgctgttaaggcagccaaagtgagatggcctgatttgttcgaaggagttgattccgctttagaggaatggatcgtcgatcaaatgcatattgtgagacctgtggttgaaactggctatgaaaatcttctacttgtgcggctgttattggagaccaagataccgtctattcgaaaatcttcagttgcagaggggttgacggttgatgggatactggagagctgggcaaagtttaagcccgtgatcatggaagcttgggatgaagatagagatgctttggtagatttgtttggaaaagttagagatgattggattaacaaggacttgacaacttggattggtgccaatagattctacccaggagtttcagatgcactgaaatttgccagctcaaagatttatatcgttaccacgaaacagggccgctttgcagaagcgttactgcgtgaaatagcaggtgtaatcataccatcagaaaggatttatggtttgggttcagggccaaaggtggaagttctaaagctacttcaagataaaccagaacatcagggcttgacgctgcagtaactcacgttctatatatctatcaataattcttctatctgcatgacttggtaatggtcaccattagtttacaatccctatgcatttttaatttggccagtttcgtggaagacagactcgcaacgctgaaaaatgtcataaaagagcctgaattagacaaatggagtttatacctaggaacctggggatacaacactgagaaagagagagctgaagcagcaggcattcccaggattcaggttattgagctctccacgtttagcaataagcttaaatgagtgcatatactcattggaaaagaaacaaagctttcctctttattgtattctacggcattcaacggaaactaaaaaccaaacatgtttaggtaagattcagtaaaagagttgaactttcagtactacccattatagaagcttttctgtgacctataattcatccttagtaagatcattcttgttacc

SEQ ID NO: 147 - DNA, 700 bp, Arabidopsis thaliana
  source 1..700: mol_type = other DNA
acatcttctcttttcttccccagcaaaaaatgagtctgcaaaatagaaaattcaagctgcgattgcgaggaagagaagagacttcagatctagcttgatccggtgataatggcgctcgagtgggtggttttaggttacgcggcggcggctgaagcgattatggtggtgctattgacgatgccaggactcgacggactccgcaagggattagtcgccgtcacgcgtaatctcctcaaaccgtttctctccatagttcctttctgtctcttcctcttaatggacatctactggaaatacgaaactatgccttcgtgcgatggcgattcctgcacaccgtcagagcatcttcgtcaccagaagtccatgatgaaatcccagcgaaacgcgcttctcattgcggctgcacttgtgttctactggatcctttactcagtcaccaatttggttgtcaagatcgagcatcttaaccagaggatcgagaggctcaggaacaaggattgatcgtctcgtctcaggttcaattagtgtaatgccttttttggttatctttcccatttggctaggttttctctttttcaacgtttctgatatgtgtcttttatcttgtggagattgaaggattttatcctacttttctatgtttggattcttatttgtaaccagattgtgattgtttcttgttgaattttgattgactcta

SEQ ID NO: 148 - DNA, 1754 bp, Arabidopsis thaliana
  source 1..1754: mol_type = other DNA
tctccacaaacaaacttgtactagaaaaatccctaaatctcaacaaaaccctaatttcaaggaagacgaagaaagaatgagttacagagtcgctaaagcatcgcagtatcttgcgatcaccggtggtgggatcacagacatcaagcttgcaaagaagtcttgggtgtttccatggcagtcttgcaccgtcttcgacgtttctccggtgaactacacgttcgaggttcaagctatgagttccgagaaacttccctttgttattcctgctgttttcacaatcggtcctcgcgttgatgatcctcacgctctcttgttgtatgccatgcttatgtctcaacacgataagcactcgaatcacgtcaatgagcttgttcagggtgttatcgaaggagagactcgtgttcttgttgcttccatgactatggaagaggtcttcaaaggaacaaaggagtttaagaaggaagtgtttgacaaggttcagctagagctaaaccagtttggtcttgtgatctacaacgccaatgtgaagcagcttgttgatgtgcctggacatgagtacttctcttacttgggccagaagactcagatggaagcagcaaaccaagccaagatcgatgtagcagaggcaaagatgaagggagaggttggtgccaaagaaaggactggactcacaatccagaatgcagccaagattgacgctgagtcaaagatcatctctactcaaaggctaggagaagggacaaaagaggagatcaaggtgaagactgaagtcaaagtgtttcagaatgagaaagaggctcttgttgctaaggctgatgcagcacttgcgattcaaaaggctgctttgtcccaaaactctcgtgtggctgaggttgaagcagccaaggctgttgctttgagggaagctgagcttcagactaaagtagagaagatgaatgcattgactcggacagagaagcttaaagctgagttcctcagtaaagccagtgttgagtatgaaactaaggtgcaagaagcgaactgggagttgtacaataagcaaaagcaagcagaagctgttctttacgagaagcagaagcaagcggaagcgacgaaagctgcagctgatgctgccttctattcaaaacagaaagatgcagagggacttgtcgcaatggccgatgctcaggggacttacctcaagaccctcttaggcgcagttaacaatgattactcagccatgagagacttcttgatgatcaacaatggcatttatcaggatattgccaagaccaatgctgttgcgatcagggacctgcagcctaagatcagcgtgtggaaccatggtggtgctgagcaggggatgaacggtggtggtaaagctacgatgaacgatattgctggactctacaagatgttaccaccggttcttgatacggtttatgagcagacagggatgcagccaccagcttggattggtacattgcgtggtgctgagcccaaacaatcacttcatgctcaacaacacagaggttgagatctcaaatgttgcttctttaattatacttttagctgttggggtttgttttctttttcttatgttatagaacttggaagttagagtttgaagttaaaacaatagtatctgacaaatgcgacttcgactagtgatttcgataaggatgtgtttttcctttttcaaatgtcagatttattattgcgtgttgaagatacctttcttctctcttgatacactaatataaataacatgttta

SEQ ID NO: 149 - DNA, 683 bp, Arabidopsis thaliana
  source 1..683: mol_type = other DNA
cacagaaccctccctctctagctctaaaaacatcccacaaactatctttcaacaacacaagacatatcacgaaacaaatcaaagcaaagatcatgaacacgattccagccgaactcactggatacttccactatctaccaccagataaatataataaccaaacaccaatcatggagtctgagtacttcaacatgccctcttctcctacttcttgttcctccttctaccacctcaatggtctgatcaacaacaacaactactcttcatcatccaatggtcaggatctaatgacgagcaacaactcaacttcagacgaagatcaccaacaaagtatggtcatcgatgagaggaaacaaaggagaatgatctctaacagggaatctgctcgtaggtcaagaatgagaaagcagagacatctcgatgagctttggtctcaagtgataagacttcgcactgataaccactgtcttatggataagctgaaccgcgtatctgaaagccatgagcttgctttaaaggagaacgctaagcttaaagaggaaacttctgatctcagacagctgatctctgagataaagtcacacaacgaagacgacaacagttttttaagagagctcgaagattcgatatcaaactctagatcggattcgaaccaaagcggcagagattttgagttgtgttaa

SEQ ID NO: 150 - DNA, 432 bp, Arabidopsis thaliana
  source 1..432: mol_type = other DNA
taagctagaggtttttagttctctgtgtggagtacggctgcattgtttctaccagtaatttgtgggatttccaagctccagtttttcgaatatggcggaagtaagtcttggtatgcttatagacattgtggacgaagagtggatgagggacactttgcctgatgatgatcttccattgcctccagtgcttgctgttaaaactgatgatactgaagaaaccaatcaggaaactcagcaagcagatgctgaaacttggcgtgatctagctcttgatacacagtaatagcctcttaagtacaatggaaaattcttacaagtcttgtttctcgttgtgtatgatcaaaaccaaaactgttcctggctttgtatttttttttggtagaagaggggggcgaacccccatttttattaaaactgaaaaactaaaaaaaa

SEQ ID NO: 151 - DNA, 3538 bp, Arabidopsis thaliana
  source 1..3538: mol_type = other DNA
gaagtagaagaagagaagtatctggagagagagaggcgtgcgatttccgcatcgaagaaacagtacggagttttatccgctccgattctgtggaagataatggggaaaggaggtgaagattgcgggaataagcaaactaatagttctgaattggtcaagtctgatacttttcctgcttggggtaaagatgtgtcggaatgcgaagagaagtttggtgttagtcgtgagaaaggtttgagcactgatgaggtgttgaaacggcatcagatctatggtttgaatgaattagagaagcctgagggtacttctatttttaagctgattttggaacagtttaatgatacattggttcgtattcttttggcggctgctgttatttcctttgtcttagccttctttgatggcgacgaaggtggtgagatgggtatcaccgcatttgttgagccgcttgttatttttctcatcttgattgttaatgccattgttggcatctggcaagaaactaatgctgagaaggcgttggaagctttgaaagagattcagtctcagcaagctaccgtcatgcgtgatgggactaaggtttccagtttgcctgcaaaggagcttgttcctggtgatattgtggaactgagggttggtgataaggtgcctgctgatatgcgtgtggttgctttgatcagttcaactttgagagtcgagcaggggtccttaacaggagagagtgaggcagtgagcaaaaccaccaagcacgtggatgagaatgctgatattcaaggaaagaaatgcatggtgtttgcaggaaccactgtcgtgaatgggaactgcatatgtttagttacagatactgggatgaatactgagattggaagggttcactcacagatccaggaagctgcacaacacgaggaagatacccctctgaagaaaaaacttaacgagtttggggaagttctgactatgatcattgggttaatttgtgcgttagtgtggctcatcaatgtcaaatactttctgtcatgggagtatgttgatggctggcccagaaactttaagttctccttcgagaagtgcacatattactttgagattgctgttgcactggcggttgctgcaattccagaaggtctgccagcagttattaccacatgtttggctcttggcactaggaagatggctcagaagaatgctctggttaggaagctacccagtgtggagactcttggatgcaccaccgtgatatgctctgacaaaactggaactcttacaaccaatcagatggctgtttcaaagctcgttgctatgggttcgaggatcggaactcttcgatctttcaatgttgaggggacctcgtttgatcctcgagatggaaagattgaagattggccaacgggtcggatggatgcaaatcttcagatgattgcaaaaattgctgccatttgcaacgatgctaatgttgagaaatctgatcagcaatttgtgtctaggggcatgcctactgaggcagctttgaaggttttggttgagaaaatgggatttcccgaaggattgaatgaagcttcatccgatggcaatgtcttacgttgttgtcggctatggagtgaactagaacaacggattgccacccttgagtttgaccgtgaccggaaatcaatgggagttatggtggattccagctcaggaaagaaactgctactggtcaagggtgccgtagaaaatgtattggaaaggagtacccatattcagctacttgatggttccactcgagagcttgaccaatactcaagggatcttattttacaaagcctacatgatatgtccttgagtgcattaagatgtctcggatttgcatactcagatgttccatcagattttgccacttatgatggcagtgaagaccatcctgctcatcagcaacttctcaacccatccaattattcatcaattgagtccaatctagtatttgttggatttgttggtttaagggatcctccaaggaaagaggtgcgtcaagccattgcagactgcagaacagcaggtattcgggtcatggttatcaccggagacaacaagagcacagcggaagcaatctgccgtgaaattggcgtatttgaagcagatgaagatatctcctcgagaagcttgacaggaaaagaatttatggatgttaaagatcagaagaatcatctaagacagacaggagggctcctgttctcaagggctgaaccaaaacacaaacaagagattgtcaggttactgaaagaagatggagaagtggttgccatgactggagatggagtcaatgatgctcctgccctgaagttggctgatattggtgtggctatgggcatttccgggacagaggtagcaaaggaggcatctgacttggtgttggcagatgataatttcagcaccattgttgcagctgttggtgaaggcaggtccatctataacaacatgaaggccttcatcaggtacatgatctcttccaacatcggtgaggttgcatcgatattcttgacagctgctcttggaatcccagaaggcatgatacccgttcaacttctgtgggtgaatctcgtaacagatggtcctccagctactgctttgggattcaacccccctgacaaggatattatgaaaaagcctcctcgtaggagcgatgactctcttatcactgcgtggatcctcttccgctatatggtgattggtttgtatgtgggagtagcaacggtgggagtattcatcatatggtacacacacaacagctttatgggcatagacctgagccaagacggtcacagccttgtgagctattcacagctcgcacattggggccaatgctcttcatgggaaggcttcaaagtgtctcctttcacagcaggctctcagactttctcgttcgactcaaacccttgcgactattttcagcagggtaaaatcaaggcatccacactctccctctcggtgttggtggccattgaaatgttcaactctctgaatgcactctcagaagatggcagcctggtgacgatgccaccctgggttaacccgtggctgctcctggcaatggctgtctcatttggactccactttgtgatattgtacgtcccattcttggctcaggtgtttggtattgtgccactgagcttgaacgagtggctgctagtgctggctgtgtcgctgccggtaattttgatagacgaagtgctcaagtttgtaggaaggtgcacgagtggctaccgctactcacctcgcactccctcagctaagcaaaaggaggagtaagaaaataattcaaaaggcattattattagactcttagttttagctgaaattaactttgttgctttactcatccttgctatatttaattctccaaacgataatttttggtttgaaaaagaaaagtttctaactttggttcatggacacagcccgtgatagaaagatgaatgtttcaaccaaaccttgattctttatgtaaacttttatggtcgaccaaattggtttttaagactgatggtaatttattttgggc

SEQ ID NO: 152 - DNA, 2087 bp, Arabidopsis thaliana
  source 1..2087: mol_type = other DNA
ataaacctacttcctttccttgcttcagctccccttttcttatccggaaaccaaaaacttccggtgataaaacctccttcgtcatctctctacttcttgctgaattttgtctgtctttgaagtggataaaatggcgtcaactttcactgccacatcttctattggttcaatggttgctccgaatggtcacaaatctgataagaaacttatcagcaagttgtcttcaagctcatttggaaggagacaaagtgtgtgtcctagacccagaagatccagttctgcaattgtgtgcgcagcaaaggaattacatttcaacaaagatgggactaccattaggagacttcaagctggtgtcaacaagctcgcagatcttgttggtgttacacttggacccaaaggacgaaatgttgttcttgagagcaagtatggatcaccacgaattgttaatgatggtgtgactgttgcaagagaggttgagttggaagacccggttgagaacattggcgctaagcttgtgaggcaagcggctgccaaaaccaatgacttggctggtgacggtacaacaacatctgttgttcttgcacaaggttttatcgctgagggtgtcaaggtggtagctgctggtgcaaaccctgttttgatcaccagaggtattgagaagacagcaaaggctttggttaccgagctcaagaaaatgtctaaggaggttgaagacagtgaacttgcagatgttgcagctgttagtgcgggtaacaacgacgaaattggaaatatgattgctgaagcaatgagcaaagtgggcaggaaaggtgtggtgacccttgaggagggtaaaagtgccgagaacaacctctacgtcgtagaaggaatgcaatttgaccgtggttatatctctccttactttgtgacagacagcgagaaaatgtccgtcgagttcgacaattgcaagttacttctcgttgacaagaaaattaccaatgcaagggatcttgttggtgttttggaggatgcaattagaggcggatacccaatattaattattgctgaagacattgaacaagaagctttagcgactcttgttgtaaacaagcttagaggtacactgaagatagcagctctcagagctccagggtttggagagcgcaagagccaataccttgatgatattgccattctaactggagcaactgtgatccgtgaggaagttggtctttcacttgacaaagctggaaaagaggttcttggtaatgcttcaaaggttgtcctcacaaaggagacctcgaccatagtgggtgatggaagcacacaggatgcagtgaaaaagcgtgttacacagattaaaaatcttattgagcaagcggagcaagattacgagaaggagaaactcaatgagagaattgcaaagctctctggtggagttgctgtgattcaggttggagcacaaactgagacagaactcaaagagaagaagttgagagttgaagatgctcttaatgcaacaaaggccgctgtcgaggaaggtattgttgttggtggtggttgcactctgcttcgtcttgcttccaaggttgatgccattaaagccacgcttgataatgatgaagaaaaggttggagcggatatagttaaaagagcactaagttaccccctaaaactaatcgccaagaatgctggtgttaatggaagtgtagttagcgagaaggtgctttccaacgataacgtgaaattcggttacaatgctgcaaccggcaagtacgaggatttgatggctgcaggaatcatcgatccaacaaaggttgtgagatgttgcttggaacacgcagcttcggttgcaaagactttcttgatgtcggactgcgttgttgttgagatcaaggaacctgaaccagttcccgtcggcaacccaatggacaactcaggatatggatactaagaggagataggctaatattgaaacggattactttagcttgcgagtgtaatgattttgaacaagagaatgtgtaatgtgaaactgaaattttgaattaatcatcatatgaataaatcatgattccctcaatgcttcgaaatatctcgaaatcgcc

SEQ ID NO: 153 - DNA, 2093 bp, Arabidopsis thaliana
  source 1..2093: mol_type = other DNA
ttaaaagcaccttccaagcgagagtaaggagataaacctacttcctttccttgcttcagctccccttttcttatccggaaaccaaaaacttccggtgataaaacctccttcgtcatctctctacttcttggataaaatggcgtcaactttcactgccacatcttctattggttcaatggttgctccgaatggtcacaaatctgataagaaacttatcagcaagttgtcttcaagctcatttggaaggagacaaagtgtgtgtcctagacccagaagatccagttctgcaattgtgtgcgcagcaaaggaattacatttcaacaaagatgggactaccattaggagacttcaagctggtgtcaacaagctcgcagatcttgttggtgttacacttggacccaaaggacgaaatgttgttcttgagagcaagtatggatcaccacgaattgttaatgatggtgtgactgttgcaagagaggttgagttggaagacccggttgagaacattggcgctaagcttgtgaggcaagcggctgccaaaaccaatgacttggctggtgacggtacaacaacatctgttgttcttgcacaaggttttatcgctgagggtgtcaaggtggtagctgctggtgcaaaccctgttttgatcaccagaggtattgagaagacagcaaaggctttggttaccgagctcaagaaaatgtctaaggaggttgaagacagtgaacttgcagatgttgcagctgttagtgcgggtaacaacgacgaaattggaaatatgattgctgaagcaatgagcaaagtgggcaggaaaggtgtggtgacccttgaggagggtaaaagtgccgagaacaacctctacgtcgtagaaggaatgcaatttgaccgtggttatatctctccttactttgtgacagacagcgagaaaatgtccgtcgagttcgacaattgcaagttacttctcgttgacaagaaaattaccaatgcaagggatcttgttggtgttttggaggatgcaattagaggcggatacccaatattaattattgctgaagacattgaacaagaagctttagcgactcttgttgtaaacaagcttagaggtacactgaagatagcagctctcagagctccagggtttggagagcgcaagagccaataccttgatgatattgccattctaactggagcaactgtgatccgtgaggaagttggtctttcacttgacaaagctggaaaagaggttcttggtaatgcttcaaaggttgtcctcacaaaggagacctcgaccatagtgggtgatggaagcacacaggatgcagtgaaaaagcgtgttacacagattaaaaatcttattgagcaagcggagcaagattacgagaaggagaaactcaatgagagaattgcaaagctctctggtggagttgctgtgattcaggttggagcacaaactgagacagaactcaaagagaagaagttgagagttgaagatgctcttaatgcaacaaaggccgctgtcgaggaaggtattgttgttggtggtggttgcactctgcttcgtcttgcttccaaggttgatgccattaaagccacgcttgataatgatgaagaaaaggttggagcggatatagttaaaagagcactaagttaccccctaaaactaatcgccaagaatgctggtgttaatggaagtgtagttagcgagaaggtgctttccaacgataacgtgaaattcggttacaatgctgcaaccggcaagtacgaggatttgatggctgcaggaatcatcgatccaacaaaggttgtgagatgttgcttggaacacgcagcttcggttgcaaagactttcttgatgtcggactgcgttgttgttgagatcaaggaacctgaaccagttcccgtcggcaacccaatggacaactcaggatatggatactaagaggagataggctaatattgaaacggattactttagcttgcgagtgtaatgattttgaacaagagaatgtgtaatgtgaaactgaaattttgaattaatcatcatatgaataaatcatgattccctcaatgcttcgaaatatctcgaaatcgcc

SEQ ID NO: 154 - DNA, 1960 bp, Arabidopsis thaliana
  source 1..1960: mol_type = other DNA
gtgaacgaagataaatttcgctattcctctctctctctctctctctctctctctctctctctctcttcttcttcttctccgttcgtgctctggactcgctcgaaatcgatccgatgataatttatgcagctcgaaacttaatttagaatcatacctttttctggatttggctgacgaatccgttttcaattgcacgagttgcttcgccaggtttatcaacttaagaatgtctaattatcaaggggatgatgctgagtacatggaagatgtggatgatgaaatggatgaggatgatttagatgaggattttcgtggggatgatatggctgcctctgattccgatgtcgatgagtttgactactctaataataaaatagctgacacttcagctgaccaagcccggaaagggaaagacatccaggggattccttgggacaggcttagtattacgagagagacatacagacaaactagactagaacagtataaaaattatgaaaatgtccctaactctggggaatcttcagggaaagattgcatggccacacagaaaggggctcttttttatgatttctggcggaatacaagatctatcaaatcaagtattcttcatttccagttgaggaatttggtttgggcaacttctaagcacgatgtctaccttatgtcacaatatttggtgagccactattctactttgacatccggaaagcatgatgttctcaatgttcaaggtcatgtttccccatctgagaaacatcctggaagtttgttggagggatttacaaagactcaagtgagtacactcgcagtgagagataaatttttagttgccggtggatttcaaggagaacttatatgcaagcatcttgatagacctggtgtgagcttttgttcacgtactacttatgatgataatgctataaccaatgctattgagatttataacaaacccagtggggcacttcattttactgcgtcgaataatgattgtggagtcagagattttgatatggagagataccagcttgttaaccagtttcgctttccatggccggtgaatcacacatctttaagtcctgatggtaaattgttgacgattgtgggagacaaccctgaaagccttctggtagaccccaacactggaaagacactggcaacgctatcaggacatctggacttttcctttgcatcagcatggcacccagatggattcacgttctccacaggtaaccaggacaagacctgccgggtttgggacattcgtaacctgtcaaaatctgttgctgtcttgaggggtaaccttggagcaatccgatccattcgctacacatctgatgggaagtacatggccatggctgagccggctgactttgtccatgtgtatgatgtctcaaacgggtatgaaacggagcaagagatcgacttctttggggagatctcgggaatatcatttagccccgacacagaagcactcttcataggcgtttgggaccgcacttacggaagtctaattgagtatagccggcgccacaactactcctaccttgattcatttctatgatcacccgacataccagaggaataaaagagccgatacatatgtgctgctgcactctcctgtcgctctgttaaactaagaaacccgagaaaagagaaaacataaactcaagtcgatctctaatggtgtaaatgatgtgttgtgcaagtactagtaggaatgttgtcacagagagcggatttagttagttaatgttcatttcttgtatgagtgttggagttcgtgtattgtacataagtatatgaggttcgggtgagtttgcatcaagtctcaactcttggcaaagagacaactttactcgagtctgtggctcgttatttggctatggtcacttgtagaggaactcaatttgagatgtttctgccgattgttggatcaaattatatatcatgatgtttc

SEQ ID NO: 155 - DNA, 2741 bp, Arabidopsis thaliana
  source 1..2741: mol_type = other DNA
aatcggcgcgtgatcgagaaagatcttctttaacctctttgcaacaaatctactcaaaaccctaacccctttttcaaattacttccatctttagatcgaatcaaatcaatgtccgtcgacgatctccctccgtcgtcggcctccgccgtaacgccactaggctcctccgtgattccgattgtgaacaagctccaagacatattcgctcagctaggaagtcaatcgacgatcgctcttccgcaagtagctgtcgtcggaagtcaaagcagtggcaaatccagcgttctagaagctctcgtcggccgtgactttcttcctcgtggcaatgatatttgcacgcgccgacctctccgtctccagcttgttcagacgaaacctagctctgatggtggatccgatgaagagtggggcgagtttcttcaccacgatcctgttagacgtatctacgatttctctgagattcgccgtgagattgaggcggagactaatagagtatcaggagagaacaaaggtgtatcagatattccgattggtttgaagatattttcacctaatgttttggatattagtcttgtggatcttcctggtatcactaaggttcctgttggtgatcagccaagtgatatcgaagcgcgtataagaacgatgatcttgacttacattaaggaacctagttgcttgatacttgctgttagccctgctaatactgatttagcaaattcagatgcattacaaatcgcaggaaatgctgatcctgatggtcatagaaccataggtgtaatcacaaagttggatattatggacagaggtactgatgctcggaatcaccttctgggaaaaacaattcctcttcgacttggatacgtgggagttgtaaatcgtagtcaagaggatattttgatgaaccgtagcatcaaggatgctcttgttgcagaggaaaagttctttcgtagtcgtccagtttacagcggtctcacagatcgtttgggtgtccctcaactggcaaagaaattaaatcaggtccttgttcaacacatcaaggcactgcttcctagtttaaagtcacgtatcaacaatgcattgtttgctacagcaaaggagtatgagagctatggggatataacagagtctaggggtggtcaaggagctcttctcctcagttttattacaaaatactgcgaagcatactcctctaccctggaagggaaaagtaaagaaatgtcaacatctgagctctcgggtggagcaagaattctctacattttccaatcagtatttgttaagagcttagaggaggttgatccatgtgaagacttaacagctgatgatattcggactgcaatacaaaatgcaactggtcccagatctgcattatttgttccagatgttccatttgaagttcttgtcaggaggcaaatatctcgtttattagatcccagccttcagtgcgctaggttcatcttcgatgagctagtaaagattagtcatcagtgtatgatgaaagagttacagcggtttccagtcctgcaaaagcgcatggatgaggttattgggaactttctgcgagaaggtcttgaaccttcgcaggcaatgatccgagatcttattgaaatggagatggattatataaacacctcacacccaaattttatcgggggaactaaagccgtggagcaagcaatgcaaacagtcaaatcttctaggattccgcatcctgttgcgcggccaagggatactgtggagcctgagaggacggcttcttccgggagtcaaataaaaacccgatcttttctcggccgacaagctaatggaatcatcactgatcaggcagttccaactgcagcagatgctgaaagacctgcaccagctggaagcacaagctggagtggtttctcatcaatttttcgggggagtgatggtcaggcagctgctaaaaacaacctattaaacaaaccattcagcgaaactactcaagaagtgtatcagaacttgtcaacaatctatttaaaggagcctccaactattttgaagtcatctgaaactcattcagaacaggagtcagttgagattgagataacaaagctattattgaaatcctactatgacattgtaaggaagaatgtcgaggacttggtcccaaaagcaatcatgcattttctggtaaattacacgaaacgtgagctgcacaatgttttcatcgagaagctttacagggagaacttaattgaagaactgttgaaagagcccgatgagttagcgataaagaggaaacgcacgcaagagactcttcgcattcttcagcaggctaatcggacgttagacgagctgccgttagaagctgaatcggtcgagagaggttacaaaattggttcagaagcgaaacatgaggagttaccgggcacaagaagatcaaggacagaaactaatgggaacggacggcttcatatgtaaattcaaattgtgattgcacgcatgactcattcatttggtgatggaaaagatttgttttcttccctttaaatcggttgtgcgtggggaaagaaaggtgttcttaggtatagtgaaacgtgatgataaacagaggttttgttgtgagggtattatcaacctactggaaaatgtgacttaatatttgtttctcaaaaccgagaagaataatcaattcctaattttacttttcatagctttatttgttacgaaaaacaagaacgtacatgagacaatgtaatgataaatttatc

SEQ ID NO: 156 - DNA, 2749 bp, Arabidopsis thaliana
  source 1..2749: mol_type = other DNA
gagaaagatcttctttaacctctttgcaacaaatctactcaaaaccctaacccctttttcaaattacttccatctttagatcgaatcaaatcaatgtccgtcgacgatctccctccgtcgtcggcctccgccgtaacgccactaggctcctccgtgattccgattgtgaacaagctccaagacatattcgctcagctaggaagtcaatcgacgatcgctcttccgcaagtagctgtcgtcggaagtcaaagcagtggcaaatccagcgttctagaagctctcgtcggccgtgactttcttcctcgtggcaatgatatttgcacgcgccgacctctccgtctccagcttgttcagacgaaacctagctctgatggtggatccgatgaagagtggggcgagtttcttcaccacgatcctgttagacgtatctacgatttctctgagattcgccgtgagattgaggcggagactaatagagtatcaggagagaacaaaggtgtatcagatattccgattggtttgaagatattttcacctaatgttttggatattagtcttgtggatcttcctggtatcactaaggttcctgttggtgatcagccaagtgatatcgaagcgcgtataagaacgatgatcttgacttacattaaggaacctagttgcttgatacttgctgttagccctgctaatactgatttagcaaattcagatgcattacaaatcgcaggaaatgctgatcctgatggtcatagaaccataggtgtaatcacaaagttggatattatggacagaggtactgatgctcggaatcaccttctgggaaaaacaattcctcttcgacttggatacgtgggagttgtaaatcgtagtcaagaggatattttgatgaaccgtagcatcaaggatgctcttgttgcagaggaaaagttctttcgtagtcgtccagtttacagcggtctcacagatcgtttgggtgtccctcaactggcaaagaaattaaatcaggtccttgttcaacacatcaaggcactgcttcctagtttaaagtcacgtatcaacaatgcattgtttgctacagcaaaggagtatgagagctatggggatataacagagtctaggggtggtcaaggagctcttctcctcagttttattacaaaatactgcgaagcatactcctctaccctggaagggaaaagtaaagaaatgtcaacatctgagctctcgggtggagcaagaattctctacattttccaatcagtatttgttaagagcttagaggaggttgatccatgtgaagacttaacagctgatgatattcggactgcaatacaaaatgcaactggtcccagatctgcattatttgttccagatgttccatttgaagttcttgtcaggaggcaaatatctcgtttattagatcccagccttcagtgcgctaggttcatcttcgatgagctagtaaagattagtcatcagtgtatgatgaaagagttacagcggtttccagtcctgcaaaagcgcatggatgaggttattgggaactttctgcgagaaggtcttgaaccttcgcaggcaatgatccgagatcttattgaaatggagatggattatataaacacctcacacccaaattttatcgggggaactaaagccgtggagcaagcaatgcaaacagtcaaatcttctaggattccgcatcctgttgcgcggccaagggatactgtggagcctgagaggacggcttcttccgggagtcaaataaaaacccgatcttttctcggccgacaagctaatggaatcatcactgatcaggcatttccaactgcagcagatgctgaaagacctgcaccagctggaagcacaagctggagtggtttctcatcaatttttcgggggagtgatggtcaggcagctgctaaaaacaacctattaaacaaaccattcagcgaaactactcaagaagtgtatcagaacttgtcaacaatctatttaaaggagcctccaactattttgaagtcatctgaaactcattcagaacaggagtcagttgagattgagataacaaagctattattgaaatcctactatgacattgtaaggaagaatgtcgaggacttggtcccaaaagcaatcatgcattttctggtaaattacacgaaacgtgagctgcacaatgttttcatcgagaagctttacagggagaacttaattgaagaactgttgaaagagcccgatgagttagcgataaagaggaaacgcacgcaagagactcttcgcattcttcagcaggctaatcggacgttagacgagctgccgttagaagctgaatcggtcgagagaggttacaaaattggttcagaagcgaaacatgaggagttaccgggcacaagaagatcaaggacagaaactaatgggaacggacggcttcatatgtaaattcaaattgtgattgcacgcatgactcattcatttggtgatggaaaagatttgttttcttccctttaaatcggttgtgcgtggggaaagaaaggtgttcttaggtatagtgaaacgtgatgataaacagaggttttgttgtgagggtattatcaacctactggaaaatgtgacttaatatttgtttctcaaaaccgagaagaataatcaattcctaattttacttttcatagctttatttgttacgaaaaacaagaacgtacatgagacaatgtaatgataaatttatcactggtaagttgatcttgttctt

SEQ ID NO: 157 - DNA, 2836 bp, Arabidopsis thaliana
  source 1..2836: mol_type = other DNA
gagaaagatcttctttaacctctttgcaacaaatctactcaaaaccctaacccctttttcaaattacttccatctttagatcgaatcaaatcaatgtccgtcgacgatctccctccgtcgtcggcctccgccgtaacgccactaggctcctccgtgattccgattgtgaacaagctccaagacatattcgctcagctaggaagtcaatcgacgatcgctcttccgcaagtagctgtcgtcggaagtcaaagcagtggcaaatccagcgttctagaagctctcgtcggccgtgactttcttcctcgtggcaatgatatttgcacgcgccgacctctccgtctccagcttgttcagacgaaacctagctctgatggtggatccgatgaagagtggggcgagtttcttcaccacgatcctgttagacgtatctacgatttctctgagattcgccgtgagattgaggcggagactaatagagtatcaggagagaacaaaggtgtatcagatattccgattggtttgaagatattttcacctaatgttttggatattagtcttgtggatcttcctggtatcactaaggttcctgttggtgatcagccaagtgatatcgaagcgcgtataagaacgatgatcttgacttacattaaggaacctagttgcttgatacttgctgttagccctgctaatactgatttagcaaattcagatgcattacaaatcgcaggaaatgctgatcctgatggtcatagaaccataggtgtaatcacaaagttggatattatggacagaggtactgatgctcggaatcaccttctgggaaaaacaattcctcttcgacttggatacgtgggagttgtaaatcgtagtcaagaggatattttgatgaaccgtagcatcaaggatgctcttgttgcagaggaaaagttctttcgtagtcgtccagtttacagcggtctcacagatcgtttgggtgtccctcaactggcaaagaaattaaatcaggtccttgttcaacacatcaaggcactgcttcctagtttaaagtcacgtatcaacaatgcattgtttgctacagcaaaggagtatgagagctatggggatataacagagtctaggggtggtcaaggagctcttctcctcagttttattacaaaatactgcgaagcatactcctctaccctggaagggaaaagtaaagaaatgtcaacatctgagctctcgggtggagcaagaattctctacattttccaatcagtatttgttaagagcttagaggtaatcactgtgtgtagatatctttgtttagttagtggggctatttgcacggaaggcagacagttcgtttcaggttttcagttcttggaagttgatccatgtgaagacttaacagctgatgatattcggactgcaatacaaaatgcaactggtcccagatctgcattatttgttccagatgttccatttgaagttcttgtcaggaggcaaatatctcgtttattagatcccagccttcagtgcgctaggttcatcttcgatgagctagtaaagattagtcatcagtgtatgatgaaagagttacagcggtttccagtcctgcaaaagcgcatggatgaggttattgggaactttctgcgagaaggtcttgaaccttcgcaggcaatgatccgagatcttattgaaatggagatggattatataaacacctcacacccaaattttatcgggggaactaaagccgtggagcaagcaatgcaaacagtcaaatcttctaggattccgcatcctgttgcgcggccaagggatactgtggagcctgagaggacggcttcttccgggagtcaaataaaaacccgatcttttctcggccgacaagctaatggaatcatcactgatcaggcagttccaactgcagcagatgctgaaagacctgcaccagctggaagcacaagctggagtggtttctcatcaatttttcgggggagtgatggtcaggcagctgctaaaaacaacctattaaacaaaccattcagcgaaactactcaagaagtgtatcagaacttgtcaacaatctatttaaaggagcctccaactattttgaagtcatctgaaactcattcagaacaggagtcagttgagattgagataacaaagctattattgaaatcctactatgacattgtaaggaagaatgtcgaggacttggtcccaaaagcaatcatgcattttctggtaaattacacgaaacgtgagctgcacaatgttttcatcgagaagctttacagggagaacttaattgaagaactgttgaaagagcccgatgagttagcgataaagaggaaacgcacgcaagagactcttcgcattcttcagcaggctaatcggacgttagacgagctgccgttagaagctgaatcggtcgagagaggttacaaaattggttcagaagcgaaacatgaggagttaccgggcacaagaagatcaaggacagaaactaatgggaacggacggcttcatatgtaaattcaaattgtgattgcacgcatgactcattcatttggtgatggaaaagatttgttttcttccctttaaatcggttgtgcgtggggaaagaaaggtgttcttaggtatagtgaaacgtgatgataaacagaggttttgttgtgagggtattatcaacctactggaaaatgtgacttaatatttgtttctcaaaaccgagaagaataatcaattcctaattttacttttcatagctttatttgttacgaaaaacaagaacgtacatgagacaatgtaatgataaatttatcactggtaagttgatcttgttctt

SEQ ID NO: 158 - DNA, 3430 bp, Arabidopsis thaliana
  source 1..3430: mol_type = other DNA
aaactaaaataaataaggaaaacactcttcttcaaatccagtagagagattcaagacgagtctcatcgaaagttcgaatctttcgtcatctgattagctttctcttagggtttatttcgatttcgatttagtgttctccatcaatggcgacacccatggttagttccgctggaggattactagcaatgctcaacgagcctcatcctgttttgaagcttcatgcgctctctaacctcaacaatttggttgaccaattctggcctgagatctccactagtgtccccatcattgagagtttatatgaagatgaagaattcgatctgcatcaaagacagcttgctgctttgctggtctctaaggttttctattacttgggcgagcttaatgattcgctgtcttatgccctaggagccggtcccttatttgatgtttcagaggattctgattatgttcatacgcttctggccaaagcaatagacgaatatgccagtctcagatcaaaggcagttgagtcaaatgagatggtggacattgatcccaggctagaggcgattgttgaaagaatgcttggaaaatgcatcagtgatgggaagtatcaacaagccatgggcattgcgatagaatgccggagattggataagttggaagaagctatcattaagagcgataatgttcagggaactttatcatattgcatcaatgtttctcattcctttgtcaaccgcagagagtacagacatgaggtgcttagtttacttgtaaaagtctaccagaagctgccctctcctgattatttgagcatttgtcaatgcctcatgtttttggatgaaccgcaaggtgttgcaagcatattggagaagcttcttcgctcagagaacaaggatgatgctttattggcattgcaaattgcatttgatcttgtagagaacgagcaccaggcctttctcttgagtgttagagatcgccttccagctcccaaaacacgtgctgtagaagcaactcaggctgttgaaacaactattgctcctaatgagaacccttcgggagatgttcagatggcagatgaaactccagctcagacaattgtgcatgagacggatccagttgatgctacatatgctgagaggttaacaaagattaagggaattttatctggagagacatctattcagctgacactgcagtttctttacagccacaacaaatcggacctgctgatactgaagacaatcaaacagtctgtagagatgcggaacagtgtatgccacagtgctacaatatatgctaatgccattatgcatgctggaactacagtggacactttccttagagagaatttggattggctaagcagggcaaccaattgggctaagttcagtgctaccgcgggattaggtgttattcacagaggtcacctgcaacagggtaggtcattgatggctccatacttgcctcagggaggagcaggtggtggtgggagtccttattccgaaggaggtgctttatatgctcttggccttattcatgctaaccatggcgagggaatcaagcaatttctacgtgatagcctacgcagcactaatgttgaggtcattcaacatggagcttgtttaggtcttggcttgtcagctctcgggacagctgatgaagagatatatgatgatgtcaaaagcgtgctttatactgacagtgcagttgctggtgaagctgctggcatcagcatgggtttattattggttggaactgctactgaaaaggcaagtgagatgctcgcttatgctcatgagacacaacatgagaagataataaggggattggctctaggaatagctcttacagtatatggtagagaagaaggagcagataccttgattgagcagatgacgagagatcaggatccaatcattcgttatggtggcatgtacgcattggcattggcttacagtggaaccgcaaacaacaaggcaattcgacaattgctgcactttgctgtatctgatgtcagtgatgatgttaggaggactgccgttctggcacttggatttgtcttgtactctgatccagagcagactccccgtattgtatcactgctttctgagtcatacaatccacatgttcgctatggtgcggctcttgcagtgggtatttcttgtgcaggcactggcctcagcgaagcgatatccttgttggagccacttacatcagatgttgttgactttgttcgtcaaggtgctttgattgcaatggccatggtgatggttcaaattagcgaagctagcgattctcgtgttggagtatttaggcgccaacttgagaagattatacttgacaagcacgaagatacaatgagcaagatgggagcgattctggcctctggtatccttgatgctggtggtaggaacgttactataagactgctctctaagaccaaacatgacaaagtcactgctgttatcggccttgcagtcttcagccagttttggtattggtacccactgatctatttcattagtttggccttctcaccaaccgctttcatcggtttgaactatgaccttaaggtcccaaagtttgagttcatgtcacatgcaaaaccgtctttatttgagtacccaaaacccaccacggttcctacagccaataccgccgttaaacttccaaccgctgttctctcaacttcagttaaagccaaagctagggctaagaaagaagcagagcaaaaagctattgctgagaaaacatctggccctgaaaagcctgtcaatgaaagtggatctggaaaaggaaaagcatcaactgagaaggaaggagactctatgcaggtcgatagcccagcagcggtcgagaagaaagcacctgagcctgagccagcgtttgagattttagtgaacccagctcgagtagtcccagctcaagagaaatacataaagttacttgatgacagcagatatgtaccagtgaagctagcaccgtcaggtttcgttcttctcaaagacttgcgtgaacacgagccagaggttctctctctgaccgacgcaccaacttcaacagcttctcctgcaactggtacagcagcggctgcacaaggaaccccggcctcagctatggccgtagatgatgagccacaacctccacaagcctttgaatacgcttcatgattttatttcatttaaaattagtgggaatttgttgttggttttattggtttctgttgaaagacaaaaggcagagagaaaaacagatctttgaactttgagataactgcttcttgtcatttgcaactggtttcatgttcaactacgatcttgtattaggtacttctctttttaagtattatctaaataattaagtgtcgttttatgtcttttagtggtactggtatatctgatttcttctacaacaagatagtaataaactacattttctaagt

SEQ ID NO: 159 - DNA, 1570 bp, Arabidopsis thaliana
  source 1..1570: mol_type = other DNA
cctcttcctcttcaagccacaaagactcataaaaatccaacctttttctcatttcctctgttaaatttttcctgaaaagtttattcctttttctacagatcgaatttcgtagttctcacctcactgaatctgttactttctctataatctaaatcttcaaaaatgtttctggttttgtgaaatcaacacttaaaaactcgagcttttacctcctctgttttttcaaagataaaaatgagagaagacgattcagactggttcgcaagatgggaagaagaacttccatcaccagaagagctcatgccaatatcacaatctctaatctcacccgatctagctctagccttcgatatacgaaccccaaatcacggaaacggaaactcaaaccaacctcatcatcatcatcatcaccaaaccacacctcctacaccgtctcagcttcagcttccatcttctcaagccaattcctcagccgaattcgctgcagattcagcagatctaggctccggaggagctgccggagacgaaccagctcggactttaaaacgacctcgtcttgtctggacaccgcagctgcataaacgtttcgttgatgctgttgcgcatttagggattaagaacgcagttcctaaaacgattatgcagcttatgagtgttgatggtttaactagagaaaacgttgcgagtcatttgcaaaagtatagactttatcttaagagaatgcaaggtttgtcttctggtggtggtgctggttcagatccagctactgatcgtcttttcgctagctctcctgttcctgctcactttcttcatcctaatcgtgttcccagttctgatcatttcatgccgtcttttgttcctattgctactcttcaacaacaacaacaaatggctgctgctgcggccgctgctgcagcagctaatcctcatttacaaccgcctcagttccaccgtcaaatcgcagctgcgcattttggttcaccgactaatggtggattcagttcaccgacgagtaatggacagtttggatcaccgactagtaatggatttggatcaccgacgactaatgggaagtttgatccttcgttcttggcggtgaggcaaacgcagcagcaaccaattcagagaatgtctacaccatcattgcatagtccagttagtaattacgttgaggatttggaatctgcaaacgctaatggagggagaactgtcttaactttattcccaactcgagacgattaaaaagtcattatctttccggttactagatgttcaaaatgtctctgcagtcatcaagaacatgagtcagctgatcgttcttgtgcatcggttttatccggtggcgtttactctgtgcagtcttatcagtttaacattgatacaatccagcgtcaatgtgtggtcaagttctgtatctgaagctcaagcaccttcaggtcaaggcttgtattaacccttgtagctttcttgtgtaagattaatgtaaagatgagtttacttttgaacgtacatccgtacgaacaaactcaagattggaaaaaagaatgaaaaaaacaaaaacttacttcac

SEQ ID NO: 160 - DNA, 3856 bp, Arabidopsis thaliana
  source 1..3856: mol_type = other DNA
cgccggggactttgatatcatctgcgccgaacaaaaactctgcagaaaccctaattttcgtcagtgattgattcttccgtttccaccatggaagaagtatgcgaaggaaaagaattctcattccctcgtcaagaagaagatgtcctctccttctggactgaaatcgatgctttcaagacacagctcaaacgcactgagaatcttcctgagtacatcttctacgacggacctccttttgccaccggacttcctcactacggacatatcctcgctggtacgattaaagatattgtgactcggtatcagaccatgactggtcaccatgtcactcgtcggtttgggtgggattgtcatggcttacctgttgagaatgagattgatcggaaattgaatattaagaggagagatgaagttattaagatgggaattgataagtataatgaagagtgtaggagtattgtgactcgttatgttgctgagtgggagaaggttattactaggtgtggtcgttggattgattttaagaatgattataagactatggatttgccttttatggaaagtgtttggtgggttttttctcagctttgggagaagaatcttgtttacagaggattcaaggttatgccgtacagtactggttgtaagacacctttatctaattttgaagctggtcagaactataaggaagtccctgatcctgaaatcatggtgacttttccggttattggggatcaagataatgctgcttttgtggcatggactactactccgtggactcttccaagcaatcttgctttgtgtgtaaatgcgaagtttgtctatgtgaaggttcgtaacaagaacactggaaaagtgtacattgttgctgaatctcggttgtctgctcttcccactgataagcctaaggccaagttaagtaatggacctgctggtgatactaagaaagcaaatcctaaagctaaaggtgctaaacctgagagtgcagctgattcttatgaagttttggagaaatttaatggagcttccctggttgggaagaagtatgaacctttgtttgattactttagtgatttctcaagtgaggcctttcgagtagtagcagatgattatgtcactgatgacagtggtactggtattgtccactgtgctcctgcctttggtgaagatgattatcgtgtttgtcttttgaacaaaataatcaaaaagggggagaatctagttgttgctgttgatgatgatgggttgtttactgagagaattacccacttcagtggccgttatgtcaaagatgcagacaaggatataattgaagccgttaaggccaagggcaggcttgttaaaacgggaagctttactcactcatacccattttgctggcgatcagacaccccactcatatatagagcagttccaagttggtttgtgcgtgtggagcagttgaaagaaaagttgttaaaaagcaatgaacagacagaatgggtacctggttatgtgaaggataaacgttttcacaattggctcgaaaatgcaagggattgggcaatcagccgaagtagattttggggcacgcctcttccgatatggataagtgatgatggggaggaagttgtgatcatggattccgtagagaagcttgaaaagctctctggtgttaaggtctttgacctgcatcgtcaccatattgatcatattacaattccatctagtcgtggcgatgagtttggtgtgctccgtcgtgtagaagatgtttttgattgttggtttgagagtgggtcaatgccttacgcgtatatccattatccgtttgaaaacaaggagttatttgagaagaactttcctggtgattttgtggctgaaggtcttgatcagactcgtggatggttttatactcttatggtgttgtctactgcattatttgaaaaaccagcgtttaaaaatctgatttgcaatggtcttgtacttgctgaggatgggaaaaagatggctaagaaattacggaattatccaccacctttggaagtcatagatgagtatggggctgatgctgtgcgattgtacctgataaattctccggttgtacgtgctgagccactacgcttcaaaaaagaaggagtactcggtgttgtcaaagatgtattccttccatggtacaatgcatatcggttcctcgttcagaatgcaaagagacttgagactgaaggtggtgtgccctttgttcctactgatctggcaactatacagtcagcaaacattcttgatcagtggattcactcagctacgcagagtcttgttcgttttgtccgcgaggagatggatgcctatcggctttacactgtggttcctcgtctcttgaagttcctcgacaatctcactaacatatatgtcagattcaaccgcaagagattaaaaggccgtacgggggaagatgattgtcacactgctctttcgactctattcaatgtgctccttacttcttgcaaagtgatggccccgtttacacctttcttcactgaaactttgtaccagaatctgcggaaagcgtgtaaaggttctgaggaaagtgttcactactgcagtattccaccaagggaaggaatggaaggggagaggattgagttaagtgttacgaggatgatgaaaatcattgatcttgctcggaacattcgtgagcgtaacaaactacccttgaaaactcctctaaaggaaatgattgtagtccatcccgatgctgatttcttaaatgacataactggagtactaagagagtatgtcttggaagaacttaacgtgagatcgcttgtaccatgcaatgatactctgaagtatgcatcactaaaagcagaaccagatttcagtgtattgggaaagcgacttggaaagtcgatggggcttgttgcaaaggaagttaaagaaatgtctcaaaaagatatcttagcatttgaggaggctggggaagttactattgctaaccacttgctaaaggaaacagatatcaagattgttagggttttcaaacgcccagacgatttgaaagagaatgagattgattcagctggagatggtgatgttttggtgattctggatctacgagcagatgattctttggttgaagcaggttttgcccgtgagattgtaaacaggatccagaaactaaggaaaaagtcaggtctggaaccaacagactttgtggaagtgtacttccaatcattggacgaggatgaatctgtttctaaacaagttctagtctctcaggaacaaaacatcaaggattcaattggctccactttacttttgtctagtttaatgccatcacatgcagtcataatagccgatgagacattcaccccaaaagaaacatccgatgagagtgtcaaaaaggttccaaagttgtcgtataagataagtttggctagaccggctttgaagttcaatgaagaggctgttcttgctttatactcaggagatgtgaaatctgcaaccgggcttcaaacatacttgttatcaagggatcattcgaatttgaagtcagagttccaagccggagatgggaagataactgtaagctgcattgaaaatgtgcctgttgcgactgtggttcttggcgaacatctccatttgagtgtcggcgatgacttattgagcaagaggaacgcatgagccgtccctccggttttgtttgatttattgtggtaacttgggatttatttcccttatttttcttcttccatatcttacctataaactacttatttagattgttgcaaaaagttaaatctcagtgttgagactctcttttactcgttctatttgtacaatactaaacttttattcatctcaaaatttatggttggac

SEQ ID NO: 161 - DNA, 2933 bp, Arabidopsis thaliana
  source 1..2933: mol_type = other DNA
atcttctttctatagtttccatgaagtcttcttcttctcagagctacgatgttttccccaacttcagaggggaagatgtccgccactcattagtcagccaccttcgtaaggaacttgatcgcaaattcatcaatacattcaacgacaacaggatcgaaagaagccgcaaaataaccccagagctgttattggctatagaaaactcaaggatctcacttgtcgtcttctctaaaaactatgcttcttccacgtggtgcttagatgaattggtgaagatccaagagtgctatgagaaattggatcaaatggtgattcctattttctacaaagtagatccttctcatgttagaaaacagaccggagagtttggcatggtctttggggagacctgcaagggcagaacagagaatgagaagcgaaaatggatgcgagctctagcagaggtagcacatctagccggagaagatcttcggaactgataagtttcaggtgggtaaacttccgataagtgattgtcggaacagtgtgtatgaggattaaacacagagaaagatcgtgtggtgattgtagtgtcggtaaacaagtttttaaagcctcccagctgtaatgtatcaaccgtcggaaaggggtgggtcccacgagcctgagtaaagacgcgtagcgaagcagaaatgcttgaaaatatcgccaaggatgtttcaaacaaactcttccccccatcaaataatttcagtgacttcgtcgggattgaagctcatatagaggcattgatatcaatgttgcgcttcgactccaagaaagcgcgaatgatagggatttgtgggccttctgaaactggtaagactactataggaagagctttatacagcagactcaaaagcgacttccaccatcgggctttcgtagcatataagagaaaaatacggagcgactatgaccagaagctgtattgggaagaacaatttctatcagaaattctttgtcagaaggatataaagatagaggaatgtggtgcggtggaacaacgactaaagcacacgaaagttcttattgttcttgatgatgttgatgatatagagctactaaaaacgttggtaggacgtatcagatggtttggatctgagagcaaaattgttgtgattactcaaaaaagggaacttctcaaggctcacaacattgcacatgtttatgaagtgggattcccatcagaagaactggctcatcaaatgttttgtcgatatgcttttgggaaaaactctccacctcatggtttcaacgagcttgcagatgaagctgcaaagattgccggtaatcgtcctaaagctctcaagtacgttggttcgtcttttagaagactagacaaggaacaatgggtgaagatgctatcggagttccgtagtaatgggaataaactaaaaatcagctatgatgagttagatggtaaaggtcaagattacgttgcgtgtttaaccaatggttcaaattcccaggtgaaggcagagtggatccacttggcactaggcgtgtctatattacttaacatccgcagtgacggaacgacaattctcaaacatttgagctacaatcgaagcatggcgcaacaagcaaaaatatggtggtatgaaaatttggaaagagtgtgcaagaagtacaatatatgtggcatagatagctcaactgatggtggtggttcaacgtatggacaatgttcaaattcccaatttcaaagaaacatggacgcaagccccgggggaaacaaaaccagtaatcaatccacaaaagattcaccgagagcttctcaagtagagaaggaaaagatcgagtactgtgagccacatgtatatataacacctgccatcttcagtgacggaaccagagctcccaaatacgtggagtctagtagccgaagagtaacccaagtgcaccacgccaaaacatggtggccggagaattgtgaaaaagtgtacgagaaccacaacaacatatatggcatagatagatcaattgacggtggtgataagtttgagggaaaaagtaaagttagtgacggtgggttagacggcaaagatcaaggttcaatgtatggacaaagttcaaattccgagcttcaaataaacatggacgcagacaataggagatgtgaacctgtgagtgagatgcttttcaaaaattacaatgtgtgttcgcctaatgcacatatgcctgcaggtttaaccgatgtaaactgttcaaatccccagtctcaaagaaaattggacgcaagcctaaagaaagacaaaattgtgcatgagtggattcgaaccggtagtggcttcttttttgattttcagggcccaaaatctatagtgagtgctgctcaagtggacgagaaaaatttcgagtactgtgaacaaggtgtgtatataacacttggcatcctcagtggcggaattatagttctcaaacatttggagttcagccgaagaatggcgcaacaagcaaaagtttggtggtcggaaaattggataaaagtgtaccaggagcacaacatatgtggcatagataaatcatttgatggtaggtttgatgatagacgtgtcattcgtcaattaagaccaaactgaagcacggcctggcccttgtaaaagtcaggacttgagctagatacttaagccaagcagatctgtttggctaagtctggtcgggttagcgcgaaattgtcgaaatctgtttaataattgcattcagtgcaagtctttaatttgtacttcatggctttaatacactaattaaacattggatcatttttagttttttcttcttttcaaaatacatatttttctaagttttccaatttagtgattttattagttctttagtagaatactggatcatggacacatgctacaacatgctttgacctaattatgaaatttatcagcgaatatattatg

SEQ ID NO: 162 - RNA, 464 nt, Cardiovirus A
  source 1..464: mol_type = genomic RNA
gagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataat

SEQ ID NO: 163 - RNA, 228 nt, Tobacco mosaic virus
  source 1..228: mol_type = genomic RNA
atctaagttaggttgtaaacatattagagacgttgttcatttggaagagttacgcgagtctttgtgtgatgtagctagtaacctaaataattgtgcgtatttttcacagttagatgaggccgttgccgaggttcataagaccgcggtaggcggttcgtttgctttttgtagtataattaaatatttgtcagataagagattgtttagagatttgttctttgtttgata

SEQ ID NO: 164 - RNA, 121 nt, Hibiscus chlorotic ringspot virus
  source 1..121: mol_type = genomic RNA
tagcttatttgggttctttatcactgtcctgattaaggctgaatcagaacaccatcacttccactcacacgacagtagtaagacacagaacatagtagttaatactggaaagtaacccacc

SEQ ID NO: 165 - RNA, 147 nt, Zea mays
  source 1..147: mol_type = mRNA
agcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagcc

SEQ ID NO: 166 - DNA, 130 bp, Arabidopsis thaliana
  source 1..130: mol_type = genomic DNA
gtaaggatttttatgatatagtatgcttatgtattttgtactgaaagcatatcctgcttcattgggatattactgaaagcatttaactacatgtaaactcacttgatgatcaataaacttgattttgcag

SEQ ID NO: 167 - DNA, 91 bp, Arabidopsis thaliana
  source 1..91: mol_type = genomic DNA
gtaacattccttagttacctttcttttctttttccatcataagtttatagattgtacatgctttgagatttttctttgcaaacaatctcag

SEQ ID NO: 168 - DNA, 108 bp, Arabidopsis thaliana
  source 1..108: mol_type = genomic DNA
gtgctcttgaaattggaactcttcttttgttgtctaaacctatcaatttctttgcggaaatttatttgaagctgtagagttaaaattgagtcttttaaacttttgtag

SEQ ID NO: 169 - DNA, 101 bp, Arabidopsis thaliana
  source 1..101: mol_type = genomic DNA
gtaagttgttacttatgattgttttcctctctgctacatgtattttgttgttcatttctgtaagatataagaattgagttttcctctgatgatattattag

SEQ ID NO: 170 - DNA, 121 bp, Arabidopsis thaliana
  source 1..121: mol_type = genomic DNA
gttagtatcatatgaagaaatacctagtttcagttgatgaatgctattttctgacctcagttgttctcttttgagaattatttcttttctaatttgcctgatttttctattaattcattag

SEQ ID NO: 171 - DNA, 124 bp, Arabidopsis thaliana
  source 1..124: mol_type = genomic DNA
gtaaatcctggtccacacttttacgataaaaacacaagattttaaactatgaactgatcaataatcattcctaaaagaccacacttttgttttgtttctaaagtaatttttactgttataacag

SEQ ID NO: 172 - DNA, 136 bp, Arabidopsis thaliana
  source 1..136: mol_type = genomic DNA
gtaagaggtcaaaaggtttccgcaatgatccctctttttttgtttctctagtttcaagaatttgggtatatgactaacttctgagtgttccttgatgcatatttgtgatgagacaaatgtttgttctatgttttag

SEQ ID NO: 173 - DNA, 150 bp, Arabidopsis thaliana
  source 1..150: mol_type = genomic DNA
gtaagttctgcatttggttatgctccttgcattttaggtgttcgtcgcacttccatttccatgaatagctaagattttttttctctgcattcattcttcttgcctcagttctaactgtttgtggtatttttgttttaattattgctacag

SEQ ID NO: 174 - DNA, 121 bp, Arabidopsis thaliana
  source 1..121: mol_type = genomic DNA
gtaaagcaactgtgttttaatcaatttcttgtcaggatatatggattataacttaatttttgagaaatctgtagtatttggcgtgaaatgagtttgctttttggtttctcccgtgttatag

SEQ ID NO: 175 - DNA, 136 bp, Arabidopsis thaliana
  source 1..136: mol_type = genomic DNA
gtaaagtttccaactttcctttaccatatcaaactaaagttcgaaactttttatttgatcaacttcaaggccacccgatctttctattcctgattaatttgtgatgaatccatattgacttttgatggttacgcag

SEQ ID NO: 176 - DNA, 121 bp, Arabidopsis thaliana
  source 1..121: mol_type = genomic DNA
gtctgtctttcctatttcatatgtttaatcctaggaatttgatcaattgattgtatgtatgtcgatcccaagactttcttgttcacttatatcttaactctctctttgctgtttcttgcag

SEQ ID NO: 177 - DNA, 159 bp, Arabidopsis thaliana
  source 1..159: mol_type = genomic DNA
gtaaaatattggatgccagacgatattctttcttttgatttgtaactttttcctgtcaaggtcgataaattttattttttttggtaaaaggtcgataatttttttttggagccattatgtaattttcctaattaactgaaccaaaattatacaaaccag

SEQ ID NO: 178 - DNA, 109 bp, Arabidopsis thaliana
  source 1..109: mol_type = genomic DNA
gtaaggacttctcatgaatattagtggcagattagtgttgttaaagtctttggttagataatcgatgcctcctaattgtccatgttttactggttttctacaattaaag

SEQ ID NO: 179 - DNA, 11185 bp, synthetic construct
  misc_feature 1..11185: note = Synthetic Construct
  source 1..11185: mol_type = other DNA
taaaaattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcactgactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaatgttaagagaaaggcagtactttaagcacgaagtgcttcactggtttgaaggaatttaaagccaggttaacaacaaaatttgagttttcggggagggagggccccccccccccgcacctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 180 - DNA, 8605 bp, synthetic construct
  misc_feature 1..8605: note = Synthetic Construct
  source 1..8605: mol_type = other DNA
taaaaattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggca

SEQ ID NO: 181 - DNA, 388 bp, Cauliflower mosaic virus
  source 1..388: mol_type = genomic DNA
ctgactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttgga

SEQ ID NO: 182 - DNA, 236 bp, Bell pepper alphaendornavirus
  source 1..236: mol_type = other DNA
gagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtggccacc

SEQ ID NO: 183 - DNA, 1654 bp, Photinus pyralis
  source 1..1654: mol_type = other DNA
aatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaa

SEQ ID NO: 184 - DNA, 113 bp, Bell pepper alphaendornavirus
  source 1..113: mol_type = other DNA
tgttaagagaaaggcagtactttaagcacgaagtgcttcactggtttgaaggaatttaaagccaggttaacaacaaaatttgagttttcggggagggagggcccccccccccc

SEQ ID NO: 185 - DNA, 191 bp, Cauliflower mosaic virus
  source 1..191: mol_type = other DNA
ctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 186 - DNA, 11332 bp, synthetic construct
  misc_feature 1..11332: note = Synthetic Construct
  source 1..11332: mol_type = other DNA
taaaaattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcactgactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaatgttaagagaaaggcagtactttaagcacgaagtgcttcactggtttgaaggaatttaaagccaggttaacaacaaaatttgagttttcggggagggagggccccccccccccgcacctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 187 - DNA, 8605 bp, synthetic construct; identical to SEQ ID NO: 180
  misc_feature 1..8605: note = Synthetic Construct
  source 1..8605: mol_type = other DNA

SEQ ID NO: 188 - DNA, 388 bp, Cauliflower mosaic virus; identical to SEQ ID NO: 181
  source 1..388: mol_type = other DNA

SEQ ID NO: 189 - DNA, 236 bp, Bell pepper alphaendornavirus; identical to SEQ ID NO: 182
  source 1..236: mol_type = other DNA

SEQ ID NO: 190 - DNA, 147 bp, Zea mays
  source 1..147: mol_type = other DNA
agcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagcc

SEQ ID NO: 191 - DNA, 1654 bp, Photinus pyralis; identical to SEQ ID NO: 183
  source 1..1654: mol_type = other DNA

SEQ ID NO: 192 - DNA, 113 bp, Bell pepper alphaendornavirus; identical to SEQ ID NO: 184
  source 1..113: mol_type = other DNA

SEQ ID NO: 193 - DNA, 191 bp, Cauliflower mosaic virus; identical to SEQ ID NO: 185
  source 1..191: mol_type = other DNA

SEQ ID NO: 194 - DNA, 9590 bp, synthetic construct
  misc_feature 1..9590: note = Synthetic Construct
  source 1..9590: mol_type = other DNA
taaaaattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcactgactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgacttgtccacaatcttttctgatgagtcgctgaaatgcgacgaaactcgatatgttcaatgttaagagaaaggcagtactttaagcacgaagtgcttcactggtttgaaggaatttaaagccaggttaacaacaaaatttgagttttcggggagggagggccccccccccccgcacctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 195 - DNA, 8605 bp, synthetic construct; identical to SEQ ID NO: 180
  misc_feature 1..8605: note = Synthetic Construct
  source 1..8605: mol_type = other DNA

SEQ ID NO: 196 - DNA, 388 bp, Cauliflower mosaic virus; identical to SEQ ID NO: 181
  source 1..388: mol_type = other DNA

SEQ ID NO: 197 - DNA, 236 bp, Bell pepper alphaendornavirus; identical to SEQ ID NO: 182
  source 1..236: mol_type = other DNA

SEQ ID NO: 198 - DNA, 59 bp, synthetic construct
  source 1..59: mol_type = other DNA
acttgtccacaatcttttctgatgagtcgctgaaatgcgacgaaactcgatatgttcaa

SEQ ID NO: 199 - DNA, 113 bp, Bell pepper alphaendornavirus; identical to SEQ ID NO: 184
  source 1..113: mol_type = other DNA

SEQ ID NO: 200 - DNA, 191 bp, Cauliflower mosaic virus; identical to SEQ ID NO: 185
  source 1..191: mol_type = other DNA

SEQ ID NO: 201 - DNA, 5784 bp, synthetic construct
  misc_feature 1..5784: note = Synthetic Construct
  source 1..5784: mol_type = other DNA
ggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaatgatcctaatacgactcactataggagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaatgttaagagaaaggcagtactttaagcacgaagtgcttcactggtttgaaggaatttaaagccaggttaacaacaaaatttgagttttcggggagggagggccccccccccccgcacctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 202 - DNA, 3760 bp, synthetic construct
  misc_feature 1..3760: note = Synthetic Construct
  source 1..3760: mol_type = other DNA
ctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaat

SEQ ID NO: 203 - DNA, 23 bp, Bacteriophage T7
  source 1..23: mol_type = other DNA
gatcctaatacgactcactatag

SEQ ID NO: 204 - DNA, 236 bp, Bell pepper alphaendornavirus; identical to SEQ ID NO: 182
  source 1..236: mol_type = other DNA

SEQ ID NO: 205 - DNA, 1654 bp, Photinus pyralis; identical to SEQ ID NO: 183
  source 1..1654: mol_type = other DNA

SEQ ID NO: 206 - DNA, 113 bp, Bell pepper alphaendornavirus; identical to SEQ ID NO: 184
  source 1..113: mol_type = other DNA

SEQ ID NO: 207 - DNA, 6738 bp, synthetic construct
  misc_feature 1..6738: note = Synthetic Construct
  source 1..6738: mol_type = other DNA
ggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaatgatcctaatacgactcactataggagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaatgttaagagaaaggcagtactttaagcacgaagtgcttcactggtttgaaggaatttaaagccaggttaacaacaaaatttgagttttcggggagggagggccccccccccccgcacctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 208 - DNA, 3760 bp, synthetic construct; identical to SEQ ID NO: 202
  misc_feature 1..3760: note = Synthetic Construct
  source 1..3760: mol_type = other DNA

SEQ ID NO: 209 - DNA, 23 bp, Bacteriophage T7
  source 1..23: mol_type = other DNA
gatcctaatacgactcactatag

SEQ ID NO: 210 - DNA, 236 bp, Bell pepper alphaendornavirus; identical to SEQ ID NO: 182
  source 1..236: mol_type = other DNA

SEQ ID NO: 211 - DNA, 1654 bp, Photinus pyralis; identical to SEQ ID NO: 183
  source 1..1654: mol_type = other DNA

SEQ ID NO: 212 - DNA, 147 bp, Zea mays; identical to SEQ ID NO: 190
  source 1..147: mol_type = other DNA

SEQ ID NO: 213 - DNA, 807 bp, Tobacco mosaic virus
  source 1..807: mol_type = other DNA
atggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaa

SEQ ID NO: 214 - DNA, 113 bp, Bell pepper alphaendornavirus; identical to SEQ ID NO: 184
  source 1..113: mol_type = other DNA

SEQ ID NO: 215 - DNA, 5866 bp, synthetic construct
  misc_feature 1..5866: note = Synthetic Construct
  source 1..5866: mol_type = other DNA
ggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaatgatcctaatacgactcactataggagggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaagacgcatccatggctgaatggttaaagcgcccaactcataattggcgaattcgtaggttcaattcctactggatgcaaagatgttaagagaaaggcagtactttaagcacgaagtgcttcactggtttgaaggaatttaaagccaggttaacaacaaaatttgagttttcggggagggagggccccccccccccgcacctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 216 - DNA, 3760 bp, synthetic construct; identical to SEQ ID NO: 202
  misc_feature 1..3760: note = Synthetic Construct
  source 1..3760: mol_type = other DNA

SEQ ID NO: 217 - DNA, 23 bp, Bacteriophage T7
  source 1..23: mol_type = other DNA
gatcctaatacgactcactatag

SEQ ID NO: 218 - DNA, 236 bp, Bell pepper alphaendornavirus; identical to SEQ ID NO: 182
  source 1..236: mol_type = other DNA

SEQ ID NO: 219 - DNA, 1654 bp, Photinus pyralis; identical to SEQ ID NO: 183
  source 1..1654: mol_type = other DNA

SEQ ID NO: 220 - DNA, 82 bp, Nicotiana tabacum
  source 1..82: mol_type = other DNA
agacgcatccatggctgaatggttaaagcgcccaactcataattggcgaattcgtaggttcaattcctactggatgcaaaga

SEQ ID NO: 221 - DNA, 113 bp, Bell pepper alphaendornavirus; identical to SEQ ID NO: 184
  source 1..113: mol_type = other DNA

SEQ ID NO: 222 - DNA, 6527 bp, synthetic construct
  misc_feature 1..6527: note = Synthetic Construct
  source 1..6527: mol_type = other DNA
ggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaatgatcctaatacgactcactataggaggtgaaatgtcttgtacgaccatttcaaatttatgtaaattgaacgcagcaacaacagggggggggcggagacgcccccccccttttaaaaataaaaatgatcaaatcaagtacgatcttggtttgatcaaatcaaaaacccctgttataaaagggtttttgaaaagaatggacgatatacaacgtccaaacttaggtacaactgcattagatcctttatttggatggttcagattgcctcgtaatgtccattgtaggatgaacaaaaacaaatttattgataattttgataatttatttgaacattataaaggtaaacaatttcataattgcaaagagatcagtatagtatgtgtagaagctatgaggggagagttacaattgaaagagcgacattatggcattgctcaatctttttctccagatgatgaacgattgagcaaatttagcgttaagaatatgtcatttggcttggtgactagattattatatttgatttatgaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaagacgcatccatggctgaatggttaaagcgcccaactcataattggcgaattcgtaggttcaattcctactggatgcaaagaccaggatatagcttgtaaatttaatatgcaaagtaaagattcttggatgaccaatggagcaacattctgtagcatggtagtttacaaaacgaatgataatgtagtagaattgggcccagatgtagtcaggatgaaatttaggtatgaagtcaccaatggtgtacacgaagcaactaaagagaacttaatgatgcgcaaggcatcttacttgatgatgttagggaaaacacctgaagttgataaattagtaaatgatctccaattacccatcaatcccgtacactggtacaattatcacacgatgttacagggcgttgctgacaaatgggacatgaacatacaacaagttgaggggtattatcataacttgatctacatgatatctaaagacgacatttatcaacataactttagaggattcggtaatagatgaatattataactaactctgttttgtcaatttatttttaaaaggatggggcacccctcccaaaccccgggcacctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 223 - DNA, 3760 bp, synthetic construct; identical to SEQ ID NO: 202
  misc_feature 1..3760: note = Synthetic Construct
  source 1..3760: mol_type = other DNA

SEQ ID NO: 224 - DNA, 23 bp, Bacteriophage T7
  source 1..23: mol_type = other DNA
gatcctaatacgactcactatag

SEQ ID NO: 225 - DNA, 504 bp, Oryza sativa alphaendornavirus
  source 1..504: mol_type = other DNA
gaggtgaaatgtcttgtacgaccatttcaaatttatgtaaattgaacgcagcaacaacagggggggggcggagacgcccccccccttttaaaaataaaaatgatcaaatcaagtacgatcttggtttgatcaaatcaaaaacccctgttataaaagggtttttgaaaagaatggacgatatacaacgtccaaacttaggtacaactgcattagatcctttatttggatggttcagattgcctcgtaatgtccattgtaggatgaacaaaaacaaatttattgataattttgataatttatttgaacattataaaggtaaacaatttcataattgcaaagagatcagtatagtatgtgtagaagctatgaggggagagttacaattgaaagagcgacattatggcattgctcaatctttttctccagatgatgaacgattgagcaaatttagcgttaagaatatgtcatttggcttggtgactagattattatatttgatttatg

SEQ ID NO: 226 - DNA, 1654 bp, Photinus pyralis; identical to SEQ ID NO: 183
  source 1..1654: mol_type = other DNA

SEQ ID NO: 227 - DNA, 82 bp, Nicotiana tabacum; identical to SEQ ID NO: 220
  source 1..82: mol_type = other DNA

SEQ ID NO: 228 - DNA, 500 bp, Oryza sativa alphaendornavirus; identical to SEQ ID NO: 21
  source 1..500: mol_type = other DNA

SEQ ID NO: 229 - DNA, 5895 bp, synthetic construct
  misc_feature 1..5895: note = Synthetic Construct
  source 1..5895: mol_type = other DNA
ggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaatgatcctaatacgactcactataggaggttttacctgatgagtccgtgaggacgaaacgagtaagctcgtcgtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaatgttaagagaaaggcagtactttaagcacgaagtgcttcactggtttgaaggaatttaaagccaggttaacaacaaaatttgagttttcggggagggagggccccccccccccggccggcatggtcccagcctcctcgctggcgccggctgggcaacatgcttcggcatggcgaatgggacgcacctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 230 - DNA, 3760 bp, synthetic construct; identical to SEQ ID NO: 202
  misc_feature 1..3760: note = Synthetic Construct
  source 1..3760: mol_type = other DNA

SEQ ID NO: 231 - DNA, 23 bp, Bacteriophage T7
  source 1..23: mol_type = other DNA
gatcctaatacgactcactatag

SEQ ID NO: 232 - DNA, 43 bp, synthetic construct
  misc_feature 1..43: note = Synthetic Construct
  source 1..43: mol_type = other DNA
ttttacctgatgagtccgtgaggacgaaacgagtaagctcgtc

SEQ ID NO: 233 - DNA, 236 bp, Bell pepper alphaendornavirus; identical to SEQ ID NO: 182
  source 1..236: mol_type = other DNA

SEQ ID NO: 234 - DNA, 1654 bp, Photinus pyralis; identical to SEQ ID NO: 183
  source 1..1654: mol_type = other DNA

SEQ ID NO: 235 - DNA, 113 bp, Bell pepper alphaendornavirus; identical to SEQ ID NO: 184
  source 1..113: mol_type = other DNA

SEQ ID NO: 236 - DNA, 68 bp, Hepatitis delta virus
  source 1..68: mol_type = other DNA
ggccggcatggtcccagcctcctcgctggcgccggctgggcaacatgcttcggcatggcgaatgggac

SEQ ID NO: 237 - DNA, 12500 bp, synthetic construct
  misc_feature 1..12500: note = Synthetic Construct
  source 1..12500: mol_type = other DNA
aattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatgcgaatagcgctagctagctgcgaacagtatgctttacagaagaatcgagctggtactgatccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggatatgtcttacagtatcactactccatctcagttcgtgttcttgtcatcagcgtgggccgacccaatagagttaattaatttatgtactaatgccttaggaaatcagtttcaaacacaacaagctcgaactgtcgttcaaagacaattcagtgaggtgtggaaaccttcaccacaagtaactgttaggttccctgacagtgactttaaggtgtacaggtacaatgcggtattagacccgctagtcacagcactgttaggtgcattcgacactagaaatagaataatagaagttgaaaatcaggcgaaccccacgactgccgaaacgttagatgctactcgtagagtagacgacgcaacggtggccataaggagcgcgataaataatttaatagtagaattgatcagaggaaccggatcttataatcggagctctttcgagagctcttctggtttggtttggacctctggtcctgcaacttgagcacctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattataaaagacctgcgtcgagctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaacacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggaggttttacctgatgagtccgtgaggacgaaacgagtaagctcgtcgtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaaaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccatggcgttagtagtcaaggatgacgttaagatttctgagttcatcaatttgtctaccgctgagaaattcttacctgctgttatgacttcggtcaagacggtacgaatttcgaaagttgacaaagtgattgcaatggaaaacgattcgttatccgatgtagatttgcttaaaggtgttaagcttgttaaagatggttatgtgtgtttggcagggttagttgtgtccggggagtggaacctaccggacaactgcagaggtggagtaagcgtttgtttggttgacaagagaatgcaaagagatgacgaagcaacacttggatcttatagaaccagtgcggctaagaaacgatttgccttcaaattgatcccgaattatagcattactaccgccgatgctgagagaaatgtttggcaagttttagttaatattagaggtgttgccatggaaaagggtttctgtcctttatctttggagtttgtctcagtttgtattgtacacaaatccaatataaaattaggcttgagagagaaaattactagtgtgtcggaaggaggacccgttgaacttacagaagcagttgttgatgagttcatcgaatcagttccaatggctgacagattacgtaaatttcgcaatcaatccaagaaaagaagtaataagtatgtaggtaagagaaatgataataagggtgtgaataaggaaaggaagctgtttgataaggttagaattgggcagaactcggagtcatcggacgccgagtcttcttcgttttaaagacgcatccatggctgaatggttaaagcgcccaactcataattggcgaattcgtaggttcaattcctactggatgcaaagagtttgagagagaagattacaaacgtgagagacggagggcccatggaacttacagaagaagtcgttgatgagttcatggaagatgtccctatgtcgatcaggcttgcaaagtttcgatctcgaaccggtgttaagagaaaggcagtactttaagcacgaagtgcttcactggtttgaaggaatttaaagccaggttaacaacaaaatttgagttttcggggagggagggccccccccccccggccggcatggtcccagcctcctcgctggcgccggctgggcaacatgcttcggcatggcgaatgggacatatgaagatgaagatgaaatatttggtgtgtcaaataaaaagcttgtgtgcttaagtttgtgtttttttcttggcttgttgtgttatgaatttgtggctttttctaatattaaatgaatgtaagatcacattataatgaataaacaaatgtttctataatccattgtgaatgttttgttggatctcttctgcagcatataactactgtatgtgctatggtatggactatggaatatgattaaagataagtaaa

SEQ ID NO: 238 - DNA, 6388 bp, synthetic construct
  misc_feature 1..6388: note = Synthetic Construct
  source 1..6388: mol_type = other DNA
aattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaat

SEQ ID NO: 239 - DNA, 388 bp, Cauliflower mosaic virus; identical to SEQ ID NO: 181
  source 1..388: mol_type = other DNA

SEQ ID NO: 240 - DNA, 482 bp, Tobacco mosaic virus
  source 1..482: mol_type = other DNA
atatgtcttacagtatcactactccatctcagttcgtgttcttgtcatcagcgtgggccgacccaatagagttaattaatttatgtactaatgccttaggaaatcagtttcaaacacaacaagctcgaactgtcgttcaaagacaattcagtgaggtgtggaaaccttcaccacaagtaactgttaggttccctgacagtgactttaaggtgtacaggtacaatgcggtattagacccgctagtcacagcactgttaggtgcattcgacactagaaatagaataatagaagttgaaaatcaggcgaaccccacgactgccgaaacgttagatgctactcgtagagtagacgacgcaacggtggccataaggagcgcgataaataatttaatagtagaattgatcagaggaaccggatcttataatcggagctctttcgagagctcttctggtttggtttggacctctggtcctgcaacttga

SEQ ID NO: 241 - DNA, 191 bp, Cauliflower mosaic virus; identical to SEQ ID NO: 185
  source 1..191: mol_type = other DNA

SEQ ID NO: 242 - DNA, 1327 bp, Arabidopsis thaliana
  source 1..1327: mol_type = other DNA
gtcgagctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaacacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagg

SEQ ID NO: 243 - DNA, 43 bp, synthetic construct; identical to SEQ ID NO: 232
  misc_feature 1..43: note = Synthetic Construct
  source 1..43: mol_type = other DNA

SEQ ID NO: 244 - DNA, 236 bp, Bell pepper alphaendornavirus; identical to SEQ ID NO: 182
  source 1..236: mol_type = other DNA

SEQ ID NO: 245 - DNA, 1654 bp, Photinus pyralis; identical to SEQ ID NO: 183
  source 1..1654: mol_type = other DNA

SEQ ID NO: 246 - DNA, 147 bp, Zea mays; identical to SEQ ID NO: 190
  source 1..147: mol_type = other DNA

SEQ ID NO: 247 - DNA, 774 bp, Pepper mild mottle virus
  source 1..774: mol_type = other DNA
atggcgttagtagtcaaggatgacgttaagatttctgagttcatcaatttgtctaccgctgagaaattcttacctgctgttatgacttcggtcaagacggtacgaatttcgaaagttgacaaagtgattgcaatggaaaacgattcgttatccgatgtagatttgcttaaaggtgttaagcttgttaaagatggttatgtgtgtttggcagggttagttgtgtccggggagtggaacctaccggacaactgcagaggtggagtaagcgtttgtttggttgacaagagaatgcaaagagatgacgaagcaacacttggatcttatagaaccagtgcggctaagaaacgatttgccttcaaattgatcccgaattatagcattactaccgccgatgctgagagaaatgtttggcaagttttagttaatattagaggtgttgccatggaaaagggtttctgtcctttatctttggagtttgtctcagtttgtattgtacacaaatccaatataaaattaggcttgagagagaaaattactagtgtgtcggaaggaggacccgttgaacttacagaagcagttgttgatgagttcatcgaatcagttccaatggctgacagattacgtaaatttcgcaatcaatccaagaaaagaagtaataagtatgtaggtaagagaaatgataataagggtgtgaataaggaaaggaagctgtttgataaggttagaattgggcagaactcggagtcatcggacgccgagtcttcttcgttttaa

SEQ ID NO: 248 - DNA, 82 bp, Nicotiana tabacum; identical to SEQ ID NO: 220
  source 1..82: mol_type = other DNA

SEQ ID NO: 249 - DNA, 127 bp, Tobacco mosaic virus
  source 1..127: mol_type = other DNA
gtttgagagagaagattacaaacgtgagagacggagggcccatggaacttacagaagaagtcgttgatgagttcatggaagatgtccctatgtcgatcaggcttgcaaagtttcgatctcgaaccgg

SEQ ID NO: 250 - DNA, 113 bp, Bell pepper alphaendornavirus; identical to SEQ ID NO: 184
  source 1..113: mol_type = other DNA

SEQ ID NO: 251 - DNA, 68 bp, Hepatitis delta virus; identical to SEQ ID NO: 236
  source 1..68: mol_type = other DNA

SEQ ID NO: 252 - DNA, 250 bp, Arabidopsis thaliana
  source 1..250: mol_type = other DNA
atatgaagatgaagatgaaatatttggtgtgtcaaataaaaagcttgtgtgcttaagtttgtgtttttttcttggcttgttgtgttatgaatttgtggctttttctaatattaaatgaatgtaagatcacattataatgaataaacaaatgtttctataatccattgtgaatgttttgttggatctcttctgcagcatataactactgtatgtgctatggtatggactatggaatatgattaaagataag

SEQ ID NO: 253 - DNA, 12624 bp, synthetic construct
  misc_feature 1..12624: note = Synthetic Construct
  source 1..12624: mol_type = other DNA
aattaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatgcgaatagcgctagctagctgcgaacagtatgctttacagaagaatcgagctggtactgatccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggatatgtcttacagtatcactactccatctcagttcgtgttcttgtcatcagcgtgggccgacccaatagagttaattaatttatgtactaatgccttaggaaatcagtttcaaacacaacaagctcgaactgtcgttcaaagacaattcagtgaggtgtggaaaccttcaccacaagtaactgttaggttccctgacagtgactttaaggtgtacaggtacaatgcggtattagacccgctagtcacagcactgttaggtgcattcgacactagaaatagaataatagaagttgaaaatcaggcgaaccccacgactgccgaaacgttagatgctactcgtagagtagacgacgcaacggtggccataaggagcgcgataaataatttaatagtagaattgatcagaggaaccggatcttataatcggagctctttcgagagctcttctggtttggtttggacctctggtcctgcaacttgagcacctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattataaaagacctgcgtcgagctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaacacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggaggttttacctgatgagtccgtgaggacgaaacgagtaagctcgtcgtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtaaatcctggtccacacttttacgataaaaacacaagattttaaactatgaactgatcaataatcattcctaaaagaccacacttttgttttgtttctaaagtaatttttactgttataacaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaaaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccatggcgttagtagtcaaggatgacgttaagatttctgagttcatcaatttgtctaccgctgagaaattcttacctgctgttatgacttcggtcaagacggtacgaatttcgaaagttgacaaagtgattgcaatggaaaacgattcgttatccgatgtagatttgcttaaaggtgttaagcttgttaaagatggttatgtgtgtttggcagggttagttgtgtccggggagtggaacctaccggacaactgcagaggtggagtaagcgtttgtttggttgacaagagaatgcaaagagatgacgaagcaacacttggatcttatagaaccagtgcggctaagaaacgatttgccttcaaattgatcccgaattatagcattactaccgccgatgctgagagaaatgtttggcaagttttagttaatattagaggtgttgccatggaaaagggtttctgtcctttatctttggagtttgtctcagtttgtattgtacacaaatccaatataaaattaggcttgagagagaaaattactagtgtgtcggaaggaggacccgttgaacttacagaagcagttgttgatgagttcatcgaatcagttccaatggctgacagattacgtaaatttcgcaatcaatccaagaaaagaagtaataagtatgtaggtaagagaaatgataataagggtgtgaataaggaaaggaagctgtttgataaggttagaattgggcagaactcggagtcatcggacgccgagtcttcttcgttttaaagacgcatccatggctgaatggttaaagcgcccaactcataattggcgaattcgtaggttcaattcctactggatgcaaagagtttgagagagaagattacaaacgtgagagacggagggcccatggaacttacagaagaagtcgttgatgagttcatggaagatgtccctatgtcgatcaggcttgcaaagtttcgatctcgaaccggtgttaagagaaaggcagtactttaagcacgaagtgcttcactggtttgaaggaatttaaagccaggttaacaacaaaatttgagttttcggggagggagggccccccccccccggccggcatggtcccagcctcctcgctggcgccggctgggcaacatgcttcggcatggcgaatgggacatatgaagatgaagatgaaatatttggtgtgtcaaataaaaagcttgtgtgcttaagtttgtgtttttttcttggcttgttgtgttatgaatttgtggctttttctaatattaaatgaatgtaagatcacattataatgaataaacaaatgtttctataatccattgtgaatgttttgttggatctcttctgcagcatataactactgtatgtgctatggtatggactatggaatatgattaaagataagtaaa

SEQ ID NO: 254 - DNA, 6388 bp, synthetic construct; identical to SEQ ID NO: 238
  misc_feature 1..6388: note = Synthetic Construct
  source 1..6388: mol_type = other DNA

SEQ ID NO: 255 - DNA, 388 bp, Cauliflower mosaic virus; identical to SEQ ID NO: 181
  source 1..388: mol_type = other DNA

SEQ ID NO: 256 - DNA, 482 bp, Tobacco mosaic virus; identical to SEQ ID NO: 240
  source 1..482: mol_type = other DNA

SEQ ID NO: 257 - DNA, 191 bp, Cauliflower mosaic virus; identical to SEQ ID NO: 185
  source 1..191: mol_type = other DNA

SEQ ID NO: 258 - DNA, 1327 bp, Arabidopsis thaliana; identical to SEQ ID NO: 242
  source 1..1327: mol_type = other DNA

SEQ ID NO: 259 - DNA, 43 bp, synthetic construct; identical to SEQ ID NO: 232
  misc_feature 1..43: note = Synthetic Construct
  source 1..43: mol_type = other DNA

SEQ ID NO: 260 - DNA, 236 bp, Bell pepper alphaendornavirus; identical to SEQ ID NO: 182
  source 1..236: mol_type = other DNA

SEQ ID NO: 261 - DNA, 1777 bp, Photinus pyralis
  source 1..1777: mol_type = other DNA
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtaaatcctggtccacacttttacgataaaaacacaagattttaaactatgaactgatcaataatcattcctaaaagaccacacttttgttttgtttctaaagtaatttttactgttataacaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaa

SEQ ID NO: 262 - DNA, 147 bp, Zea mays; identical to SEQ ID NO: 190
  source 1..147: mol_type = other DNA

SEQ ID NO: 263 - DNA, 774 bp, Pepper mild mottle virus; identical to SEQ ID NO: 247
  source 1..774: mol_type = other DNA

SEQ ID NO: 264 - DNA, 82 bp, Nicotiana tabacum; identical to SEQ ID NO: 220
  source 1..82: mol_type = other DNA

SEQ ID NO: 265 - DNA, 127 bp, Tobacco mosaic virus; identical to SEQ ID NO: 249
  source 1..127: mol_type = other DNA

SEQ ID NO: 266 - DNA, 113 bp, Bell pepper alphaendornavirus; identical to SEQ ID NO: 184
  source 1..113: mol_type = other DNA

SEQ ID NO: 267 - DNA, 68 bp, Hepatitis delta virus; identical to SEQ ID NO: 236
  source 1..68: mol_type = other DNA

SEQ ID NO: 268 - DNA, 250 bp, Arabidopsis thaliana; identical to SEQ ID NO: 252
  source 1..250: mol_type = other DNA

SEQ ID NO: 269 - DNA, 6950 bp, synthetic construct
  misc_feature 1..6950: note = Synthetic Construct
  source 1..6950: mol_type = other DNA
ctagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaatgatcctaatacgactcactataggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaaaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccatggcgttagtagtcaaggatgacgttaagatttctgagttcatcaatttgtctaccgctgagaaattcttacctgctgttatgacttcggtcaagacggtacgaatttcgaaagttgacaaagtgattgcaatggaaaacgattcgttatccgatgtagatttgcttaaaggtgttaagcttgttaaagatggttatgtgtgtttggcagggttagttgtgtccggggagtggaacctaccggacaactgcagaggtggagtaagcgtttgtttggttgacaagagaatgcaaagagatgacgaagcaacacttggatcttatagaaccagtgcggctaagaaacgatttgccttcaaattgatcccgaattatagcattactaccgccgatgctgagagaaatgtttggcaagttttagttaatattagaggtgttgccatggaaaagggtttctgtcctttatctttggagtttgtctcagtttgtattgtacacaaatccaatataaaattaggcttgagagagaaaattactagtgtgtcggaaggaggacccgttgaacttacagaagcagttgttgatgagttcatcgaatcagttccaatggctgacagattacgtaaatttcgcaatcaatccaagaaaagaagtaataagtatgtaggtaagagaaatgataataagggtgtgaataaggaaaggaagctgtttgataaggttagaattgggcagaactcggagtcatcggacgccgagtcttcttcgttttaaagacgcatccatggctgaatggttaaagcgcccaactcataattggcgaattcgtaggttcaattcctactggatgcaaagagtttgagagagaagattacaaacgtgagagacggagggcccatggaacttacagaagaagtcgttgatgagttcatggaagatgtccctatgtcgatcaggcttgcaaagtttcgatctcgaaccgg

SEQ ID NO: 270 - DNA, 3760 bp, synthetic construct; identical to SEQ ID NO: 202
  misc_feature 1..3760: note = Synthetic Construct
  source 1..3760: mol_type = other DNA

SEQ ID NO: 271 - DNA, 23 bp, Bacteriophage T7
  source 1..23: mol_type = other DNA
gatcctaatacgactcactatag

SEQ ID NO: 272 - DNA, 236 bp, Bell pepper alphaendornavirus; identical to SEQ ID NO: 182
  source 1..236: mol_type = other DNA

SEQ ID NO: 273 - DNA, 1777 bp, Photinus pyralis; identical to SEQ ID NO: 261
  source 1..1777: mol_type = other DNA

SEQ ID NO: 274 - DNA, 147 bp, Zea mays; identical to SEQ ID NO: 190
  source 1..147: mol_type = other DNA

SEQ ID NO: 275 - DNA, 774 bp, Pepper mild mottle virus; identical to SEQ ID NO: 247
  source 1..774: mol_type = other DNA

SEQ ID NO: 276 - DNA, 82 bp, Nicotiana tabacum; identical to SEQ ID NO: 220
  source 1..82: mol_type = other DNA

SEQ ID NO: 277 - DNA, 127 bp, Tobacco mosaic virus; identical to SEQ ID NO: 249
  source 1..127: mol_type = other DNA

SEQ ID NO: 278 - DNA, 113 bp, Bell pepper alphaendornavirus; identical to SEQ ID NO: 184
  source 1..113: mol_type = other DNA

SEQ ID NO: 279 - RNA, 33 nt, Hordeum vulgare alphaendornavirus
  source 1..33: mol_type = genomic RNA
agaggtcgagtggcttaaagccactcgacctct

SEQ ID NO: 280 - RNA, 33 nt, Lagenaria siceraria alphaendornavirus
  source 1..33: mol_type = genomic RNA
ggggagagacctccattttggaggtctttcctc

SEQ ID NO: 281 - RNA, 33 nt, Lagenaria siceraria alphaendornavirus
  source 1..33: mol_type = genomic RNA
ggggagagacctccattttggaggtctctcctc

SEQ ID NO: 282 - RNA, 33 nt, Hot pepper alphaendornavirus
  source 1..33: mol_type = genomic RNA
ttcatgggtgtactggaaacagtatacccatga

SEQ ID NO: 283 - RNA, 33 nt, Bell pepper alphaendornavirus
  source 1..33: mol_type = genomic RNA
ttcatgggtgtactggtaacagtatacccatga

SEQ ID NO: 284 - RNA, 33 nt, Cluster bean alphaendornavirus 1
  source 1..33: mol_type = genomic RNA
aacttaggtgtgtgcgaaagcacacacctaagt

SEQ ID NO: 285 - RNA, 33 nt, Phaseolus vulgaris alphaendornavirus 2
  source 1..33: mol_type = genomic RNA
ctcatgagcacacgagcaatcgtgtgctcatga

SEQ ID NO: 286 - RNA, 33 nt, Basella alba alphaendornavirus 1
  source 1..33: mol_type = genomic RNA
acctgaacgaggtgataaaacacctcgttcagg

SEQ ID NO: 287 - RNA, 33 nt, Cucumis melo alphaendornavirus
  source 1..33: mol_type = genomic RNA
agggagagacctcctttttggaggtctctcctt

SEQ ID NO: 288 - RNA, 33 nt, Oryza sativa alphaendornavirus
  source 1..33: mol_type = genomic RNA
atgatcaaatcaagtacgatcttggtttgatca

SEQ ID NO: 289 - RNA, 33 nt, Helianthus annuus alphaendornavirus
  source 1..33: mol_type = genomic RNA
caaagtagccatcaacacccaggccactctagg

SEQ ID NO: 290 - RNA, 33 nt, Lagenaria siceraria alphaendornavirus
  source 1..33: mol_type = genomic RNA
gcaaatgcagtataaaacagatgcaattactcc

SEQ ID NO: 291 - RNA, 33 nt, Phaseolus vulgaris alphaendornavirus 2
  source 1..33: mol_type = genomic RNA
atgctctgcaagaaacgtatacagacagagcaa

SEQ ID NO: 292 - RNA, 33 nt, Cluster bean alphaendornavirus 1
  source 1..33: mol_type = genomic RNA
accaaggtaaaattacatgatgatcttgagact

SEQ ID NO: 293 - RNA, 33 nt, Bell pepper alphaendornavirus
  source 1..33: mol_type = genomic RNA
ggccgatgttactaccaccatcaaaacaagacg

SEQ ID NO: 294 - RNA, 33 nt, Oryza sativa alphaendornavirus
  source 1..33: mol_type = genomic RNA
tcaaaaacccctgttataaaagggtttttgaaa

SEQ ID NO: 295 - RNA, 33 nt, Vicia faba alphaendornavirus
  source 1..33: mol_type = genomic RNA
gcgtaatctgcaccgatttaacagaaatattaa

SEQ ID NO: 296 - RNA, 33 nt, Phaseolus vulgaris alphaendornavirus 1
  source 1..33: mol_type = genomic RNA
caagccttctatcaagcaattaggttgggtagg

SEQ ID NO: 297 - RNA, 33 nt, Hot pepper alphaendornavirus
  source 1..33: mol_type = genomic RNA
tggacattagaacaattagaaatatgatgttat

SEQ ID NO: 298 - RNA, 27 nt, Oryza sativa alphaendornavirus
  source 1..27: mol_type = genomic RNA
agggggggggcggagacgccccccccc

SEQ ID NO: 299 - RNA, 27 nt, Bell pepper alphaendornavirus
  source 1..27: mol_type = genomic RNA
accgttttacggtggacctagtaaaat

SEQ ID NO: 300 - RNA, 27 nt, Phaseolus vulgaris alphaendornavirus 2
  source 1..27: mol_type = genomic RNA
tctttgggtggttcacaccacccgaaa

SEQ ID NO: 301 - RNA, 27 nt, Yerba mate alphaendornavirus
  source 1..27: mol_type = genomic RNA
gagggggcactcgaaagggtgcctcct

SEQ ID NO: 302 - RNA, 27 nt, Oryza rufipogon alphaendornavirus
  source 1..27: mol_type = genomic RNA
agggggggggcggagacgccccccccc

SEQ ID NO: 303 - RNA, 27 nt, Cluster bean alphaendornavirus 1
  source 1..27: mol_type = genomic RNA
ttcattgccacttggtggctggccaag

SEQ ID NO: 304 - RNA, 27 nt, Persea americana alphaendornavirus 1
  source 1..27: mol_type = genomic RNA
ggagggggcctcgaaagaggccccctt

SEQ ID NO: 305 - RNA, 27 nt, Cucumis melo alphaendornavirus
  source 1..27: mol_type = genomic RNA
cgaagaccctcttgctggcgtggttaa

SEQ ID NO: 306 - RNA, 27 nt, Basella alba alphaendornavirus 1
  source 1..27: mol_type = genomic RNA
gaagattcattcctccgattagaaata

SEQ ID NO: 307 - RNA, 27 nt, Lagenaria siceraria alphaendornavirus
  source 1..27: mol_type = genomic RNA
gattagaagttttgaaaaactatttaa

SEQ ID NO: 308 - RNA, 27 nt, Lagenaria siceraria alphaendornavirus
  source 1..27: mol_type = genomic RNA
caaatgcaaatgaatacagatgcaatt

SEQ ID NO: 309 - RNA, 27 nt, Hordeum vulgare alphaendornavirus
  source 1..27: mol_type = genomic RNA
gaaccatggtaccctgtgcattggctt

SEQ ID NO: 310 - RNA, 27 nt, Helianthus annuus alphaendornavirus
  source 1..27: mol_type = genomic RNA
cggtgccccagcgaaagtcaaggactg

SEQ ID NO: 311 - RNA, 27 nt, Vicia faba alphaendornavirus
  source 1..27: mol_type = genomic RNA
atcgccgccggctccagtcggcgaccc

SEQ ID NO: 312 - RNA, 25 nt, Persea americana alphaendornavirus 1
  source 1..25: mol_type = genomic RNA
taatgatatagcctgtgaattcaat

SEQ ID NO: 313 - RNA, 25 nt, Winged bean alphaendornavirus 1
  source 1..25: mol_type = genomic RNA
aagccaaaactaagtagcgtggttg

SEQ ID NO: 314 - RNA, 25 nt, Basella alba alphaendornavirus 1
  source 1..25: mol_type = genomic RNA
gcctcctatattatgatgctggggc

SEQ ID NO: 315 - RNA, 25 nt, Bell pepper alphaendornavirus
  source 1..25: mol_type = genomic RNA
tcagtcgactaaacaatgagacaaa

SEQ ID NO: 316 - RNA, 25 nt, Helianthus annuus alphaendornavirus
  source 1..25: mol_type = genomic RNA
cacctggatttttaaacacctagcg

SEQ ID NO: 317 - RNA, 25 nt, Yerba mate alphaendornavirus
  source 1..25: mol_type = genomic RNA
tgaatcggaacataaaggagattca

SEQ ID NO: 318 - RNA, 25 nt, Cucumis melo alphaendornavirus
  source 1..25: mol_type = genomic RNA
catgcaaagcaaagattcttgggtg

SEQ ID NO: 319 - RNA, 25 nt, Phaseolus vulgaris alphaendornavirus 2
  source 1..25: mol_type = genomic RNA
ttgcacactgggaccagatgtggtg

SEQ ID NO: 320 - RNA, 25 nt, Phaseolus vulgaris alphaendornavirus 3
  source 1..25: mol_type = genomic RNA
agaatcaaggagctaacaggagatt

SEQ ID NO: 321 - RNA, 25 nt, Oryza sativa alphaendornavirus
  source 1..25: mol_type = genomic RNA
tgatatctaaagacgacatttatca

SEQ ID NO: 322 - RNA, 40 nt, Persea americana alphaendornavirus 1
  source 1..40: mol_type = genomic RNA
gagctacaacggtgcaactttttgtagcatgatactagct

SEQ ID NO: 323 - RNA, 40 nt, Phaseolus vulgaris alphaendornavirus 2
  source 1..40: mol_type = genomic RNA
tgtccaaatggggtgagtgaaatgactcccgacaatgtac

SEQ ID NO: 324 - RNA, 40 nt, Hot pepper alphaendornavirus
  source 1..40: mol_type = genomic RNA
gaatgaagaacggcaactattaaagatgttaagagagagg

SEQ ID NO: 325 - RNA, 40 nt, Basella alba alphaendornavirus 1
  source 1..40: mol_type = genomic RNA
acaaatggggtacacgagatgaacgatttgaataacttga

SEQ ID NO: 326 - RNA, 40 nt, Cucumis melo alphaendornavirus
  source 1..40: mol_type = genomic RNA
gtggctcataagtataatatgaacgaggagcaggttagag

SEQ ID NO: 327 - RNA, 40 nt, Oryza sativa alphaendornavirus
  source 1..40: mol_type = genomic RNA
tagaggattcggtaatagatgaatattataactaactctg

SEQ ID NO: 328 - RNA, 40 nt, Lagenaria siceraria alphaendornavirus
  source 1..40: mol_type = genomic RNA
caaatatgatatgacgcacgtacaagtgctagatgtatat

SEQ ID NO: 329 - RNA, 40 nt, Bell pepper alphaendornavirus
  source 1..40: mol_type = genomic RNA
tgcgcttacgacggcggttcgaatgccccaatggggtaag

SEQ ID NO: 330 - RNA, 30 nt, Yerba mate alphaendornavirus
  source 1..30: mol_type = genomic RNA
gaaattcaatatgcaaagcaaagataattg

SEQ ID NO: 331 - RNA, 30 nt, Phaseolus vulgaris alphaendornavirus 1
  source 1..30: mol_type = genomic RNA
catgtttaatatgcaaagcaaagaatcatg

SEQ ID NO: 332 - RNA, 30 nt, Winged bean alphaendornavirus 1
  source 1..30: mol_type = genomic RNA
gcgagaaacagttgcaaacaaaaaattcag

SEQ ID NO: 333 - RNA, 30 nt, Cluster bean alphaendornavirus 1
  source 1..30: mol_type = genomic RNA
gatgtcttattgcatgatgttaggagacat

SEQ ID NO: 334 - RNA, 30 nt, Vicia faba alphaendornavirus
  source 1..30: mol_type = genomic RNA
ctacctacacatgctaggcaaaagtgagga

SEQ ID NO: 335 - RNA, 30 nt, Lagenaria siceraria alphaendornavirus
  source 1..30: mol_type = genomic RNA
tgtccagatgtggttagacttaaatttaga

SEQ ID NO: 336 - RNA, 30 nt, Hordeum vulgare alphaendornavirus
  source 1..30: mol_type = genomic RNA
ggaactccaacgcaagagccacagaggaca

SEQ ID NO: 337 - RNA, 30 nt, Phaseolus vulgaris alphaendornavirus 3
  source 1..30: mol_type = genomic RNA
tggcatataagtgggaagtaccgaatggcc

SEQ ID NO: 338 - DNA, 540 bp, Oryza sativa alphaendornavirus
  source 1..540: mol_type = other DNA
atagtatggcaaaggaaagcagtttgtagtttatttgccaaattgtttgtaagatgcaaagacagactgaaaactttacttgtggatcatatactttacgtagatggattgagaccagatgaaatatcagccaaattaagacaaatatctgatgtatttggattttttgaaaacgacctgactaagcaagatagacaaactgacaaacccattttagaagtggaaatgttgatgtatcttatgttgggcgttcatcctaacatcatatctagttggcgttcaagtcatgatgattggagattcaaatctacaaattattggggtaagagcacggcaatgagattaacgggacaagctacaaccgcactaggaaattgtatcactaatatgcaagtacactcaaaatttgtaatcaaaaataaatattggttaaagtttgctttatttcttggggatgatatgtgtatgggtttctcacacaagccaaacacacagcacttacgccaggatatagcttgtaaatttaatatgcaaagtaaa

SEQ ID NO: 339 - DNA, 633 bp, Vicia faba alphaendornavirus
  source 1..633: mol_type = other DNA
atcgtgtggcaaccaaaagaactgtgcgccctaatgtcaccagcctttatagccatcaagcgaaggctgaaagaggtgctccgagatgagatcgtctacaccgacggtctgacaccagacatgctgtcggctcgcgctagaaccatccagtacgactacgtgtttgaagatgaccttgtaatacaagacaggcagacggatcaagaactaattgatttagaattccaagtgatgttggatttagggctcgacattaatttagcaaacttatggagactagttcacaacaagtggagattcaaaggtcaacacagctggggccaactagacgctatgaggctcacaggtcaagctacgacagctcttggaaacgcaataaccaacctgtgtgtgcacagcagctttgttattgaacacaggcaggcgataaaactgatgtttgtgctaggcgatgacaacattacattcatgtcagcggagccaaacctcacaaagtacaaaagattgatgagcgaaagatacaacatgcgaagcaagccccaggttagcaggaacgtcggcacattttgcagcttactgtgctaccgaaacagcttcggtcattgtgaggtagggccagactttgtacggtta

SEQ ID NO: 340 - DNA, 648 bp, Oryza rufipogon alphaendornavirus
  source 1..648: mol_type = other DNA
atagtgtggcaaaggaaggcagtttgtggtctgtttgctaaactttttgtgagatgtaaggaaagattgaaaaccctactattggaccacatactctatgtagatggactaagaccagatgaaatatcagccaaactgagacaaatatccaatgtgtttggtttcttcgaaaatgatttaactaaacaagacagacagactgataaaccaatacttgaagtggaaatgttgatgtacttgatgttaggtgttcaccctaatattatcgctagctggcgtgcaagccatgaagattggagatttaaatcaacaaactactggggcaagagtacagccatgagactcactggacaagctaccacagcccttggaaattgtatcacaaacatgcaagttcactcgaagtttgtcattaagaataagtactggttaaaatttgctttatttcttggcgatgacatgtgtatgggtttttcacacaaaccaaacacacaacatttacgccaggacatagcttgcaaatttaatatgcaaagcaaggactcatgggtactcaatggggctactttttgtagtatggtagtttacaaaacaaatgatgacgtagttgaaattggtcctgatgtagtcaggatgaaattcaggttt

SEQ ID NO: 341 - DNA, 906 bp, Persea americana alphaendornavirus 1
  source 1..906: mol_type = other DNA
ttttgtgacacctacttcaacccaaactggagaagccaagccgccatgtaccaagagaacaacttgattatcgaagagagtgatgtgagggcatggatagaagatagcaaagatagcaacaaaatagtaaaagaattaaaggaactgttagccggggagatgttgataaagcccatgaatgatgtcaacgtccacttaaaactagagagcttgctgaaagctaatccaattaatgtgactaaagaacagcaggcaagagtgatagtgtggcaaaggaagtgtgtatgcgccctgtatgctagattattccttaagatcaaatcacggctaaaagagatattgcatgagaaaattgtgtacgcggatggtctaacaccagatgacatatcagcaagagtcaggttgtgtaacaacgttaatggattcttcgagaatgatctgacaaagcaagacagacaaactgaccgagatatcatcaacatggaaatgcttgtgtatattgtgttgggagccaatccaagcattatatcttcatggagggagatgcacgaagtatggagattcaaatcggccaattactggggtgaaggaaaagagatgcgactatcaggccaagccacaacagcactcggaaacgtgataacgaatttacaggtgcattgcaaatttgtaaagaagaattcaatatccatgcagttgggactatttctaggtgatgacatgtgtatgttgttcagcgagaaaccatcaatcaaaaatttacgtaatgatatagcctgtgaattcaatatgcaaagtaaggatgaatggagctacaacggtgcaactttttgtagcatgatactagctaaaacgtcggacacaacagcagaggtagcggctgacgtggtacgactgaaattcagg

SEQ ID NO: 342 - DNA, 642 bp, Lagenaria siceraria alphaendornavirus
  source 1..642: mol_type = other DNA
atagtttggcaaaggaaagctgtatgtgctatatactcaaatttgttcgtcaaagtgaaggatagattgaaatctatattacatgataaaataatttacgctgacgggttaagaccagatgaaatctcagcaagagtgaggctgtgcaaagatatagctggtttctttgaaaatgacttaactaaacaagataggcaaactgacgcgccaattataactacagaaatgtacatgtatgacttattgggagtacaccctaatgtgatagcttcttggagggaaatgcatgaagtttggagattcaaatcgaatcactactgggggcaaggtcaaggcatgagattgactggacaagcaactacagccattggtaattgcataaccaatttacaggtgcaccaagaatttgtcaagaaaaatttttctattttagaattagctttatttctaggagatgacatgtgcatggttttcagagagaaaccagacacaaagaacttaaggaaaaatatcgcaactaaattcaacatgcaaagtaaagacgcatggtacagaaacggagcaacgttctgtagtatggtcatgagtcgcacaccaacaggtgcagagctatgccctgatgtggtcagactcaagtttaga

SEQ ID NO: 343 - DNA, 636 bp, Yerba mate alphaendornavirus
  source 1..636: mol_type = other DNA
attgtgtggcaaaggaaatctatatgtgcaatatattcgaaattatttgtaaaagtcaaaaatcggttaaaggatgtattaaacgaaaaaattttgtacacagatggattaaggccggatgaaatatcagcaagaattagattgtgtaataatgtaaaaggtttctttgagaatgacctgaccaaacaagataggcaaacagacaagccaattatagatgtagaaatggcaatgtatgacatactgggggttcacacagacgtaataagatcatggagagagatgcatgagacatggaggttcaagtcaaaaaattattggggccaaggggaatcaatgagattaactggccaagccacgactgctataggtaattgcttaacaaacatgcaagtgcatcaaagtttcgttaagaaaaatttttacaatcttaaattggcattattcttaggagatgatatgtgcatgttatttgatgcaacaccgaatataaaaagcttaaggaaggatattgcaacgaaattcaatatgcaaagcaaagataattggtgtaataacggggcgacattttgcagcatggtattatgtaaactgccaaatgacagggctgaattagctgcagatgtagtcaggctt

SEQ ID NO: 344 - DNA, 1017 bp, Hot pepper alphaendornavirus
  source 1..1017: mol_type = other DNA
tatagcagaccagtcttaacaaaagcggcaaaccaggagtttaatgccataacaggaagattgcacaacattacaacttatagaagacagaattacaatgtggcgaaagagttgcaaaagtttgttttcacttactttgatgcaagtaaagcagacatattggcatctttcacacaaaataaattaacttatagtgatgcaaaagtgttagattggttgcgggacaggccagacagtaacaaagttgcagccgagttggaggtaattttgcaagagggaatgcaattgcatgctattaacagattaaatgttcacctgaaattggaatcactgttgaaatctgaaccagccaatagtttaaaacaggtaaaagcaagagcattgctatggcagtgcaaagggtattgtgcaatatttagtcacatattcaaagaggcaaaggttagactaaaacaagtgctcaaacccaacatagtttattctgatgggttgagagcggatgagttgtcagccagggtgaggctaacaacaggagtgaaatatctcttggaaaacgacttggctcaacaagacaaacaaaccgatcatgaaatcatcagatttgaaatggcattgtacaaactattgggcgtgcatgaagacgttataactctgtggcacaatagtcattttaattggaaatacaaatcaaaatcggttagaggagaaggagatgctatgcggttaacaggtcaagcgacaactgctttaggaaatgcaatcacgaacatgttggtgcacagaaaattggtgaatagcttagggaacaatttaagattgtttttagtgctaggtgatgacggattgatgttcagcaatgcaaatgtggatgtgagtaagctaaacaatgaaacgaaaataaaacacaatatgatgtgcaaaccacatgtaagtaacactcacggtacattttgctgtatgatagcttgtattacacaagaaggaaattgctcattgggtccggacgtagtcaggtta

SEQ ID NO: 345 - DNA, 621 bp, Hordeum vulgare alphaendornavirus
  source 1..621: mol_type = other DNA
ttgaaatcacaaccagttgtggatcataggcaaacaaaggccaggatcttagtatggcaagcaaaaggcatgtgtgccatatacagccccgtgttcaaaatggcaaaagacaggttaaaatcactgctaaacacaaaaactgtatatgcagacggattgcgtccggaccaattagcactgagagtgatgcaagcggatcctgccaattacatcatggagaatgacctggaacaacaagataggcaaaccgatgacaaactgttggatgtggaaatggcaatttaccacatgttgggtgtgcaggaagaactgttgtcgctatggaggcagtgccataacaactggaattttaagggaaggtcatgtcgcggagaacgaaattggatgaggctaacaggccaggccaccactgcactaggcaacgcaataaccaatttgtgcgtgcattggcggctgtgcagcaaattgggcaacgattggaaactgtttgtgttattaggagatgatggagcgttattgaccaacaggacattgtcaaacaaggaggtaaaaacccacggaaaattgttgtataacatgataatgaaacccaatacacacaataatgtcggcacattttgc

SEQ ID NO: 346 - DNA, 642 bp, Cucumis melo alphaendornavirus
  source 1..642: mol_type = other DNA
atcgtttggcagagaaaagccgtttgtgctatctactcaaacctctttgtagaagttaaacgtagattgaaagaagtgttgcacagaaaaattgtatatgcagatggactacgaccagatgaaatatcagccagggtaaggctagtcaagaatgtagctggattctttgaaaatgatttaactaaacaagatagacaaactgataaacctattattgaagtagaattgatgatatatgatttattgggagttcatccaaacgtaatagcatcttggaaagaaatgcatgaggtgtggagatttaagtcaaatttgtactggggtcaaggagaaggtatgcggttgactggacaggcaacgactgcacttggcaattgtttgaccaatcttcaagtacaccaaaactttacaaagacaaatttctgtatattgcaactagggttatttttaggggatgatatgtgtatggtgttcagtgagaagccagatacgtcaaatctcagaaaagatattgcaaccagcttcaacatgcaaagcaaagattcttgggtgataaatggagctactttttgcagtatggtaatgactagaactaactttggagccgaattagcaccagacgttgtgagacttaagttcaga

SEQ ID NO: 347 - DNA, 957 bp, Winged bean alphaendornavirus 1
  source 1..957: mol_type = other DNA
aagtatgctagaccagtactgaccaaagccgccaaccaagaatttaatgctataacggggagattgtgcaaagttgaaacttacaggaagtataattacgacattaaagaacaaatcaacttatttgtaactacatacgtggatcctaataagttgcatctattgagtgaatttaagcaaaacgagttgactatgaacgacgggaaagtgctagactggttacgtgacagaccagatgccaacaaaatagcagaagaactggaaatgattttggcagaagggttagaagtgcacccgatcaatgacattaaggtgcacctgaaattagaatctttattgaaagaggaaccagcaactcatctaaaacaggtcaaggctagagctctgatgtggcaatgtaaggggtattgtagtattttttcacacatatttaaagaaattaagacccgacttaaaagtgtacttaagcccaacatagtgtacaccgatggtttaagggctgacgaactatcgtcaatagtgagaaatgtgaaggatttcagccacttcttggaaaatgacctagtgcagcaagatcgacaaacggatcatgaagtcattaaattcgaaatgcagatttacaaactgctgggtgctaatgcggacgtgataaatttgtggcacaattgtcattttcattggaaatacaaagcagcctccgctatgggtatcagggatgccatgagactaacaggtcaagcaaccacggctataggaaattgtctcacaaatctacttgttcacatgaagttggtcaagagacttgggagtcagctaaaactatttttagttctaggtgacgatgggttgatgttaatagacggaatggtgaataccgactcgttgaatcgggagttgaaggttcaccacaatatgatgtgcaagccaaaactaagtagcgtggttggaacattttgt

SEQ ID NO: 348 - DNA, 642 bp, Lagenaria siceraria alphaendornavirus
  source 1..642: mol_type = other DNA
attgtttggcaacgaaaagctgtatgcgcaatatattccaatttatttgtgaaggtgaaagataggttaaaatctattttgcatgacaaaataatttacgcagatggattgagaccagatgaaatttcagctagagtaagattatgcaaagacatagctggtttctttgaaaatgacttgacaaaacaagatagacaaaccgacgcaccgattataaccactgaaatgtacatgtacgacttgttaggagttcaccctaatgtgatagcctcctggagagagatgcatgaggtttggagatttaaatcaaaccattactggggacaaggtcaaggtatgaggctaactggacaagcaactacagctattggtaattgcataaccaatttgcaagtgcatcaggaattcgtcaagaaaaatttctcaatcttagagttagctttgtttttaggagatgatatgtgtatggtttttagagaaaaaccggacacaaaaaatctaaggaaaaatatagcaactaagttcaacatgcaaagcaaagatgcatggtatcgaaatggagcaacattttgcagcatggtcatgagtcgcacaccaacaggcgctgagctatgtccagatgtggttagacttaaatttaga

SEQ ID NO: 349 - DNA, 906 bp, Phaseolus vulgaris alphaendornavirus 2
  source 1..906: mol_type = other DNA
gtgcgcaaatttgtagacatgtactttgatagttcaaaacgtgacaagttgaaggtttatcaaactcagcaattaacatttaatgacgcaaaagtgctagattggttaagggatcgtccggatagtaataaaatagcagaagaactgaacaatattttagctgagggtatgcaactgcacccaatcaacaaattaaacgtgcacttgaaattggagtcgctgttgaaatcagagccagcgtcaaatttgaaacaagttaaggctagagctttagtttggcagtgtaaaggatattgcgccatatttagtcacgtgttcaaagaagttaaagttagactcaaagatttgttgcgaccagaaattgtgtattcagatggcttaagagcggatgaattggctgcaagagtaaggttgaccacaaatgtcaaatttttgctggaaaatgacttggcccaacaagacaaacaaaccgatcatgagataatcaaggttgaaatggaaatttataaattgttaggcgtgtgtcctcacctagtagatttatggaaaaattgtcaccatagttgggcctacaagtctaggactgtagcaggtgtaggtgacgctatgcgactcactggccaagccaccactgctatagggaacgccatcactaatatgctggtgcataggcggttggttaaaacgttgggccacaacctaagattgtttttggtgttgggtgatgatggattaatgttcacaacaacatgggtggataccactaagttgaataacgagctgaaaaccaaccataacatgatgtgcaaaccaagtttaagtcagactcatggtgtgttttgctgcatgatggcagcaataactgatgaaggtaattgcacactgggaccagatgtggtgcgatta

SEQ ID NO: 350 - DNA, 1017 bp, Bell pepper alphaendornavirus
  source 1..1017: mol_type = other DNA
tacagcagaccagtattaaccaaagcagcaaatcaagaattcaatgccatcactggtagattgcacaacattacaacctataggagacaaaactacaacgtggataaagagctgcaaaaatttgtggcaacttattttgatgcagacaaagcagacatattgacttcatttgcgcaaaacaagctgacttacaatgatgcaaaagtgttggattggttgagagacagacctgatagtaataaggtagcagtagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaagcaaatgttaaaaccaaacattgtttatgctgacggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaactacagctctgggaaatgctataaccaatatgttggtgcatagacgattagttaaccggctcggacataatctaagattgtttttaattttaggagatgatggtctcatgtttaccaatacgagcatagatctcagtcgactaaacaatgagacaaagatcaaacacaatatgatgtgtaaaccacacgttagcaacacatacggagtgttttgttgcatgatcgcatgcataacacaacaaggtaattgctcactgggtccagatgtagtgcgctta

SEQ ID NO: 351 - DNA, 576 bp, Phaseolus vulgaris alphaendornavirus 1
  source 1..576: mol_type = other DNA
attgtttggcaacgtaaggctgtgtgcgcagtgtacactagtgtattcgtggaggcaaaaagacggttgaaagctattttgcatgacaaaattgtatatgccgatggcttgcggccagatgagttatcagcacgattaagactatgcaattctgtagctgggttctttgagaatgatttaaccaaacaagaccgacaaacggacaaaccaattatagacgctgagatgataatttatgatatgttaggagtacacgcaaatgtaatcgcttcatggagagaaatgcatgaaacatggatgttcaaatcagataactattggggcacaggccaagccatgcgattaacaggacaagcaacaactgccattgggaatgtattaactaacatgcaagtgcacgctaaattcatacacaaacactggaatactttggaagttggtctgttcttgggagatgatatgtgtctagtgttcaaacataaaccttcttaccaccatttgaagaatgacatcgcaaccatgtttaatatgcaaagcaaagaatcatggaatagcaactatgggactttttgtagt

SEQ ID NO: 352 - DNA, 909 bp, Phaseolus vulgaris alphaendornavirus 3
  source 1..909: mol_type = other DNA
catgaggtgatcgataaaatagcactttacttcttcgacctacgttggaaggagcttaccaacacctttcagtctaatcccataatgtacaatgaaaaagattttctagattgggtttcaaagcacaaaaatccaggcaaagttatcaaggaattagagaaaatgtcggctgaaggtatactgctgaatcctttcaatcaatttagaagtcatgttaaacttgagagtattaacaaaaataatcccgtaatggattttagacagtcggctccgagagccatagtttggctgccttacttcatgccagcgatatttagttacatgttcaaaatggcaagtgacaggttcaaattgttgcttagaaataacgttcactacacctcgggcgtcgacgtcattgatttgtcgaaaatagttaacgaagttgataccggcttttacttgttcgacaatgacattagcaagatggactcgcagattgacgaggacatggtacgagttgaatgggaagttctcagactcctgggaatagatgccgaggtcatggaggtttacaaactattaaagaacaactggaggattagcaataaattcctgagcgttaggggggattggcttagacatagtggagaaccaacgacagcgttgggaaatggaataatcaatttagccataacgagtttggtacttgaaaacacgtgtagatccaacattaaactatgcctctttgtcggtgatgacctaataatagcaaatgaagtgtctgaagatttgcaaatgattaaaaggaaaggtagagaattagcaaacgctatattaaaacctaatcaaagcaggaccaatgggcctttctgtagtttcataataggtgccagcgaaacttctgaccgactttgcgtagtacccaac

SEQ ID NO: 353 - DNA, 486 bp, Helianthus annuus alphaendornavirus
  source 1..486: mol_type = other DNA
atagtgtggcaacggaaagcctggtgcgcgatattctcaccggtattcctacaagccaaagcaagattaaaagccatactaagcaggaaagtcctgtatgcagacggactaacacaagaggagttatcttcaagggttaatcttatacatggcgactgttggtttatggaggatgacctgagcaaacaagatagacaaacggacattaatctgatacaatgtgaaatgtatatatactcacaactaggggtagcagatgacgtgctgaacttatggagacgaacacacgaaaactggaaattcagaggaacaaatgtgtcggggatattgaccggcatgagactcaccggacaagccactacagcagtaggcaacgccatagtcaacttgttagtacacagcaggattttcgaaaccaacaagaatcatattgagttaatgctattactaggggacgacaatcttgttataagcagaaaccgaatc

SEQ ID NO: 354 - DNA, 621 bp, Cluster bean alphaendornavirus 1
  source 1..621: mol_type = other DNA
aaaggactatgcgcaatcttttcgcctgttttcaaggaagccaagcagcgactcaaatccgtgttgggcgttaaaaccctgtacgcggatggcctacggccagatcaattggctagtagagtggcacaagtcccaacaaccagctatttgattgaaaatgacatgcaacagcaggacagacaaacggatgagactttactgaacatcgaaatgcagttgtacttgatcctaggtgtggaccaggctttggttggtttgtggcgttcttgtcatgacaactggtattttaggggtaaatcatgttctggttacaaacacgccatgcgactaaccgggcaagctacgacagcgctaggaaatgctatcaccaatttggcagtgcattggaggatctgtcaaagcttaggacgagattggaagtggttttgtgtgttaggagatgacggaatattgatgagtgacaggaaattggatgcagaggacctaaagacatatgggaagaagtactgtaacatgattttgaagcctaaagtgtcaaaaaatagtgcaacattttgttgcttcacgatttatcggactagaagaggcaactttgcactagggcccgacccaatacggttg

SEQ ID NO: 355 - protein, 180 aa, Oryza sativa alphaendornavirus
IVWQRKAVCSLFAKLFVRCKDRLKTLLVDHILYVDGLRPDEISAKLRQISDVFGFFENDLTKQDRQTDKPILEVEMLMYLMLGVHPNIISSWRSSHDDWRFKSTNYWGKSTAMRLTGQATTALGNCITNMQVHSKFVIKNKYWLKFALFLGDDMCMGFSHKPNTQHLRQDIACKFNMQSK

SEQ ID NO: 356 - protein, 211 aa, Vicia faba alphaendornavirus
IVWQPKELCALMSPAFIAIKRRLKEVLRDEIVYTDGLTPDMLSARARTIQYDYVFEDDLVIQDRQTDQELIDLEFQVMLDLGLDINLANLWRLVHNKWRFKGQHSWGQLDAMRLTGQATTALGNAITNLCVHSSFVIEHRQAIKLMFVLGDDNITFMSAEPNLTKYKRLMSERYNMRSKPQVSRNVGTFCSLLCYRNSFGHCEVGPDFVRL

SEQ ID NO: 357 - protein, 216 aa, Oryza rufipogon alphaendornavirus
IVWQRKAVCGLFAKLFVRCKERLKTLLLDHILYVDGLRPDEISAKLRQISNVFGFFENDLTKQDRQTDKPILEVEMLMYLMLGVHPNIIASWRASHEDWRFKSTNYWGKSTAMRLTGQATTALGNCITNMQVHSKFVIKNKYWLKFALFLGDDMCMGFSHKPNTQHLRQDIACKFNMQSKDSWVLNGATFCSMVVYKTNDDVVEIGPDVVRMKFRF

SEQ ID NO: 358 - protein, 302 aa, Persea americana alphaendornavirus 1
FCDTYFNPNWRSQAAMYQENNLIIEESDVRAWIEDSKDSNKIVKELKELLAGEMLIKPMNDVNVHLKLESLLKANPINVTKEQQARVIVWQRKCVCALYARLFLKIKSRLKEILHEKIVYADGLTPDDISARVRLCNNVNGFFENDLTKQDRQTDRDIINMEMLVYIVLGANPSIISSWREMHEVWRFKSANYWGEGKEMRLSGQATTALGNVITNLQVHCKFVKKNSISMQLGLFLGDDMCMLFSEKPSIKNLRNDIACEFNMQSKDEWSYNGATFCSMILAKTSDTTAEVAADVVRLKFR

SEQ ID NO: 359 - protein, 214 aa, Lagenaria siceraria alphaendornavirus
IVWQRKAVCAIYSNLFVKVKDRLKSILHDKIIYADGLRPDEISARVRLCKDIAGFFENDLTKQDRQTDAPIITTEMYMYDLLGVHPNVIASWREMHEVWRFKSNHYWGQGQGMRLTGQATTAIGNCITNLQVHQEFVKKNFSILELALFLGDDMCMVFREKPDTKNLRKNIATKFNMQSKDAWYRNGATFCSMVMSRTPTGAELCPDVVRLKFR

SEQ ID NO: 360 - protein, 212 aa, Yerba mate alphaendornavirus
IVWQRKSICAIYSKLFVKVKNRLKDVLNEKILYTDGLRPDEISARIRLCNNVKGFFENDLTKQDRQTDKPIIDVEMAMYDILGVHTDVIRSWREMHETWRFKSKNYWGQGESMRLTGQATTAIGNCLTNMQVHQSFVKKNFYNLKLALFLGDDMCMLFDATPNIKSLRKDIATKFNMQSKDNWCNNGATFCSMVLCKLPNDRAELAADVVRL

SEQ ID NO: 361 - protein, 339 aa, Hot pepper alphaendornavirus
YSRPVLTKAANQEFNAITGRLHNITTYRRQNYNVAKELQKFVFTYFDASKADILASFTQNKLTYSDAKVLDWLRDRPDSNKVAAELEVILQEGMQLHAINRLNVHLKLESLLKSEPANSLKQVKARALLWQCKGYCAIFSHIFKEAKVRLKQVLKPNIVYSDGLRADELSARVRLTTGVKYLLENDLAQQDKQTDHEIIRFEMALYKLLGVHEDVITLWHNSHFNWKYKSKSVRGEGDAMRLTGQATTALGNAITNMLVHRKLVNSLGNNLRLFLVLGDDGLMFSNANVDVSKLNNETKIKHNMMCKPHVSNTHGTFCCMIACITQEGNCSLGPDVVRL

SEQ ID NO: 362 - protein, 207 aa, Hordeum vulgare alphaendornavirus
LKSQPVVDHRQTKARILVWQAKGMCAIYSPVFKMAKDRLKSLLNTKTVYADGLRPDQLALRVMQADPANYIMENDLEQQDRQTDDKLLDVEMAIYHMLGVQEELLSLWRQCHNNWNFKGRSCRGERNWMRLTGQATTALGNAITNLCVHWRLCSKLGNDWKLFVLLGDDGALLTNRTLSNKEVKTHGKLLYNMIMKPNTHNNVGTFC

SEQ ID NO: 363 - protein, 214 aa, Cucumis melo alphaendornavirus
IVWQRKAVCAIYSNLFVEVKRRLKEVLHRKIVYADGLRPDEISARVRLVKNVAGFFENDLTKQDRQTDKPIIEVELMIYDLLGVHPNVIASWKEMHEVWRFKSNLYWGQGEGMRLTGQATTALGNCLTNLQVHQNFTKTNFCILQLGLFLGDDMCMVFSEKPDTSNLRKDIATSFNMQSKDSWVINGATFCSMVMTRTNFGAELAPDVVRLKFR

SEQ ID NO: 364 - protein, 319 aa, Winged bean alphaendornavirus 1
KYARPVLTKAANQEFNAITGRLCKVETYRKYNYDIKEQINLFVTTYVDPNKLHLLSEFKQNELTMNDGKVLDWLRDRPDANKIAEELEMILAEGLEVHPINDIKVHLKLESLLKEEPATHLKQVKARALMWQCKGYCSIFSHIFKEIKTRLKSVLKPNIVYTDGLRADELSSIVRNVKDFSHFLENDLVQQDRQTDHEVIKFEMQIYKLLGANADVINLWHNCHFHWKYKAASAMGIRDAMRLTGQATTAIGNCLTNLLVHMKLVKRLGSQLKLFLVLGDDGLMLIDGMVNTDSLNRELKVHHNMMCKPKLSSVVGTFC

SEQ ID NO: 365 - protein, 214 aa, Lagenaria siceraria alphaendornavirus; identical to SEQ ID NO: 359

SEQ ID NO: 366 - protein, 302 aa, Phaseolus vulgaris alphaendornavirus 2
VRKFVDMYFDSSKRDKLKVYQTQQLTFNDAKVLDWLRDRPDSNKIAEELNNILAEGMQLHPINKLNVHLKLESLLKSEPASNLKQVKARALVWQCKGYCAIFSHVFKEVKVRLKDLLRPEIVYSDGLRADELAARVRLTTNVKFLLENDLAQQDKQTDHEIIKVEMEIYKLLGVCPHLVDLWKNCHHSWAYKSRTVAGVGDAMRLTGQATTAIGNAITNMLVHRRLVKTLGHNLRLFLVLGDDGLMFTTTWVDTTKLNNELKTNHNMMCKPSLSQTHGVFCCMMAAITDEGNCTLGPDVVRL

SEQ ID NO: 367 - protein, 339 aa, Bell pepper alphaendornavirus
YSRPVLTKAANQEFNAITGRLHNITTYRRQNYNVDKELQKFVATYFDADKADILTSFAQNKLTYNDAKVLDWLRDRPDSNKVAVELEVILEEGMQLHAINRLNVHLKLESLLKAEPASSLKQVKARALLWQCKGYCAIFSHIFKEAKVRLKQMLKPNIVYADGLRADELSARVRLTTGVKYLLENDLAQQDKQTDHEIIKFEMALYKLLGVHDDVITLWHNSHFNWKYKSRTVRGEGDAMRLTGQATTALGNAITNMLVHRRLVNRLGHNLRLFLILGDDGLMFTNTSIDLSRLNNETKIKHNMMCKPHVSNTYGVFCCMIACITQQGNCSLGPDVVRL

SEQ ID NO: 368 - protein, 192 aa, Phaseolus vulgaris alphaendornavirus 1
IVWQRKAVCAVYTSVFVEAKRRLKAILHDKIVYADGLRPDELSARLRLCNSVAGFFENDLTKQDRQTDKPIIDAEMIIYDMLGVHANVIASWREMHETWMFKSDNYWGTGQAMRLTGQATTAIGNVLTNMQVHAKFIHKHWNTLEVGLFLGDDMCLVFKHKPSYHHLKNDIATMFNMQSKESWNSNYGTFCS

SEQ ID NO: 369 - protein, 303 aa, Phaseolus vulgaris alphaendornavirus 3
HEVIDKIALYFFDLRWKELTNTFQSNPIMYNEKDFLDWVSKHKNPGKVIKELEKMSAEGILLNPFNQFRSHVKLESINKNNPVMDFRQSAPRAIVWLPYFMPAIFSYMFKMASDRFKLLLRNNVHYTSGVDVIDLSKIVNEVDTGFYLFDNDISKMDSQIDEDMVRVEWEVLRLLGIDAEVMEVYKLLKNNWRISNKFLSVRGDWLRHSGEPTTALGNGIINLAITSLVLENTCRSNIKLCLFVGDDLIIANEVSEDLQMIKRKGRELANAILKPNQSRTNGPFCSFIIGASETSDRLCVVPN

SEQ ID NO: 370 - protein, 162 aa, Helianthus annuus alphaendornavirus
IVWQRKAWCAIFSPVFLQAKARLKAILSRKVLYADGLTQEELSSRVNLIHGDCWFMEDDLSKQDRQTDINLIQCEMYIYSQLGVADDVLNLWRRTHENWKFRGTNVSGILTGMRLTGQATTAVGNAIVNLLVHSRIFETNKNHIELMLLLGDDNLVISRNRI

SEQ ID NO: 371 - protein, 207 aa, Cluster bean alphaendornavirus 1
KGLCAIFSPVFKEAKQRLKSVLGVKTLYADGLRPDQLASRVAQVPTTSYLIENDMQQQDRQTDETLLNIEMQLYLILGVDQALVGLWRSCHDNWYFRGKSCSGYKHAMRLTGQATTALGNAITNLAVHWRICQSLGRDWKWFCVLGDDGILMSDRKLDAEDLKTYGKKYCNMILKPKVSKNSATFCCFTIYRTRRGNFALGPDPIRL

SEQ ID NO: 372 - DNA, 18 bp, Bell pepper alphaendornavirus
  source 1..18: mol_type = other DNA
taaaacaaacaaggtttt

SEQ ID NO: 373 - DNA, 60 bp, Bell pepper alphaendornavirus
  source 1..60: mol_type = other DNA
tgtaatggcttcatcctccattacgtgtagtaatcctagtactttgtataccgtttcgag

SEQ ID NO: 374 - DNA, 18 bp, Bell pepper alphaendornavirus
  source 1..18: mol_type = other DNA
taaaacaaacaaggtttt

SEQ ID NO: 375 - DNA, 19 bp, Bell pepper alphaendornavirus
  source 1..19: mol_type = other DNA
gtaagacaaacaaggtttt

SEQ ID NO: 376 - DNA, 18 bp, Bell pepper alphaendornavirus
  source 1..18: mol_type = other DNA
gtaaaacaaacaaggttt

SEQ ID NO: 377 - DNA, 18 bp, Bell pepper alphaendornavirus
  source 1..18: mol_type = other DNA
taaatcaacccaggtttt

SEQ ID NO: 378 - DNA, 12 bp, Winged bean alphaendornavirus 1
  source 1..12: mol_type = other DNA
gacatttttaaa

SEQ ID NO: 379 - DNA, 18 bp, Cluster bean alphaendornavirus 1
  source 1..18: mol_type = other DNA
ataaagacccgcagccca

SEQ ID NO: 380 - DNA, 95 bp, unidentified
  source 1..95: mol_type = other DNA; note = unclassified Endornaviridae
gctcccattacgtgtcgtattccaagtactctgtatacagtttcgagggagagacctcctttttggaggtctctccttaagaaactaaaattaaa

SEQ ID NO: 381 - DNA, 18 bp, Bell pepper alphaendornavirus
  source 1..18: mol_type = other DNA
taaaacaaacaaggtttt

SEQ ID NO: 382 - DNA, 154 bp, unidentified
  source 1..154: mol_type = other DNA; note = unclassified Endornaviridae
aacttaccaatcttaagacataaacacccaacttctcgatctcttacactttctgaggtgaacccctttcacgccgcctggtgccggcccgcaccggacggcgtgaaaacaaaccaaaagagggcagtcctgcgcaagacgacactgcggcacg

SEQ ID NO: 383 - DNA, 18 bp, unidentified
  source 1..18: mol_type = other DNA; note = unclassified Endornaviridae
gtaaataaaataaaaagg

SEQ ID NO: 384 - DNA, 74 bp, Cucumis melo alphaendornavirus
  source 1..74: mol_type = other DNA
agagatacttgcgggtcagtggcagccaacataagcttcgaagaccctcttgctggcgtggttaacttcgaagc

SEQ ID NO: 385 - DNA, 19 bp, Bell pepper alphaendornavirus
  source 1..19: mol_type = other DNA
gtaaaacaaacaaggtttt

SEQ ID NO: 386 - DNA, 18 bp, unidentified
  source 1..18: mol_type = other DNA; note = unclassified Endornaviridae
tcaaataaaataaaaagg

SEQ ID NO: 387 - DNA, 11 bp, unidentified
  source 1..11: mol_type = other DNA; note = unclassified Endornaviridae
aacctactatc

SEQ ID NO: 388 - DNA, 16 bp, Bell pepper alphaendornavirus
  source 1..16: mol_type = other DNA
aaacaaacaaggtttt

SEQ ID NO: 389 - DNA, 18 bp, Bell pepper alphaendornavirus
  source 1..18: mol_type = other DNA
taaaacaaacaaggtttt

SEQ ID NO: 390 - DNA, 106 bp, unidentified
  source 1..106: mol_type = other DNA; note = unclassified Endornaviridae
tgccaaatactgcaattcccaagataaatggtataaaatgtaatggcttctcacatttaattaaggtgctcccagaactacgttcaggagcaccattaaaaaataa

SEQ ID NO: 391 - DNA, 17 bp, Phaseolus vulgaris alphaendornavirus 2
  source 1..17: mol_type = other DNA
ttccgatctgtcgtcca

SEQ ID NO: 392 - DNA, 27 bp, unidentified
  source 1..27: mol_type = other DNA; note = unclassified Endornaviridae
ccgcacaccaacagtgctatcattgta

SEQ ID NO: 393 - DNA, 112 bp, Oryza sativa alphaendornavirus
  source 1..112: mol_type = other DNA
gcaggtcctcttcgccagctccccccccttttaaaaataaaaatgatcaaatcaagtacgatcttggtttgatcaaatcaaaaacccctgttataaaagggtttttgaaaag

SEQ ID NO: 394 - DNA, 57 bp, Oryza sativa alphaendornavirus
  source 1..57: mol_type = other DNA
gtacgatcttggtttgatcaaatcaaaaacccctgttataaaagggtttttgaaaag

SEQ ID NO: 395 - DNA, 22 bp, unidentified
  source 1..22: mol_type = other DNA; note = unclassified Endornaviridae
acttacaaccaccacacccccc

SEQ ID NO: 396 - DNA, 19 bp, Bell pepper alphaendornavirus
  source 1..19: mol_type = other DNA
gtaaaacaaacaaggtttt

SEQ ID NO: 397 - DNA, 23 bp, unidentified
  source 1..23: mol_type = other DNA; note = unclassified Endornaviridae
gacaatattaaaagcacgcaaca

SEQ ID NO: 398 - DNA, 11 bp, Hordeum vulgare alphaendornavirus
  source 1..11: mol_type = other DNA
gtcaaccaacc

SEQ ID NO: 399 - DNA, 11 bp, Hordeum vulgare alphaendornavirus
  source 1..11: mol_type = other DNA
atcaaccaacc

SEQ ID NO: 400 - DNA, 167 bp, Phaseolus vulgaris alphaendornavirus 1
  source 1..167: mol_type = other DNA
attggattaatatattggctgtggtaacctaatttaagtactttgttaactactttgcgtctagcatttccgtatgtaatggctccaaggtttattacatgtcttaactcaaataaccaggcaaaactaacgggacctcgaaagaggtcccaaattttaaaatctaa

SEQ ID NO: 401 - DNA, 22 bp, Phaseolus vulgaris alphaendornavirus 2
  source 1..22: mol_type = other DNA
aagataatttgattgtcgtcca

SEQ ID NO: 402 - DNA, 20 bp, Bell pepper alphaendornavirus
  source 1..20: mol_type = other DNA
ggtaaaacaaacaaggtttt

SEQ ID NO: 403 - DNA, 19 bp, Bell pepper alphaendornavirus
  source 1..19: mol_type = other DNA
gtaaaacaaacaaggtttt

SEQ ID NO: 404 - DNA, 20 bp, Helianthus annuus alphaendornavirus
  source 1..20: mol_type = other DNA
acctattgactaatagggac

SEQ ID NO: 405 - DNA, 79 bp, Bell pepper alphaendornavirus
  source 1..79: mol_type = other DNA
cttttgctttacgtttactgggtggctctcgccccccgaaaactcaaattcttcatgggtgtactggtaacagtatacc

SEQ ID NO: 406 - DNA, 260 bp, Bell pepper alphaendornavirus
  source 1..260: mol_type = other DNA
cagaagttatgaatgaagtaaaggttcagaatttgccaattcaaccggtcaaatggtatgacgtggatagcataaggtcagcagtcgctgagaaatataacatgagtgatgaagaggtcataaatgaagagcggcagcttttaaaaatgttaagagaaaggcagtactttaagcacgaagtgcttcactggtttgaaggaatttaaagccaggttgacaacaaaatttgagttttcggggagggagggcccccccccccc

SEQ ID NO: 407 - DNA, 249 bp, Cucumis melo alphaendornavirus
  source 1..249: mol_type = other DNA
taaaggtcctaacgttgacgatacggttaggatgttaaacttacctatcaaaccaatagcatggtacaatttcgatcacatggtgaccgctgtggctcataagtataatatgaacgaggagcaggttagaggttattatgatcaattgttagccacaatcagaagtgacaacatttattcacatgtatttagacatttctctaataaatagtttcttaaggagaggaaaaatcctctctcccccccccc

SEQ ID NO: 408 - DNA, 671 bp, Bell pepper alphaendornavirus
  source 1..671: mol_type = other DNA
ttaagtcaaatttgtactggggccaaggagaaggtatgcggttgactggacaggctacgactgcacttggcaattgtttgaccaatcttcaagtacaccaaaactttacgaagacaaattttcgtatattgcaactagggttatttttaggggatgatatgtgtatggtgttcagtgagaagccagacacgtcaaacctcagaaaagatattgcaaccagcttcaacatgcaaagcaaagactcttgggtgataaacggagctactttttgcagtatggtaatgactagaaccaactttggagccgaattagcaccagacgttgtgagactcaagttcagatatgaagtaccaaatggagtgcatgaggctacaccaactaatgtactaatgagaaaagcttcatatctaatgatgttgggtaaaggtcctaacgttgacgatacggttaggatgttaaacttacctatcaaaccaatagcatggtacaacttcgatcacatggtgaccgctgtggctcataagtataatatgaatgaggagcaggttagaggttattatgatcaattgttagccacaatcagaagtgacaacatttattcacatgtgtttagacatttctctaataaatagtttcttaaggagaggaaaaatcctctctccccccccccc

SEQ ID NO: 409 - DNA, 259 bp, Bell pepper alphaendornavirus
  source 1..259: mol_type = other DNA
cagaagttatgaatgaagtaaaggttcagaatttgccaattcaaccggtcaaatggtatgacgtggatagcataaggtcagcagtcgctgagaaatataacatgagtgatgaagaggtcataaatgaagagcggcagcttttaaaaatgttaagagaaaggcagtactttaagcatgaagtgcttcactggtttgaaggaatttaaagccaggttaacaacaaaatttgagttttcgggggagggagggcccccccccc

SEQ ID NO: 410 - DNA, 22 bp, Bell pepper alphaendornavirus
  source 1..22: mol_type = other DNA
cagaagttatgagtgaagttaa

SEQ ID NO: 411 - DNA, 246 bp, Bell pepper alphaendornavirus
  source 1..246: mol_type = other DNA
cagaagttatgaatgaagtaaaggttcagaatttgccaattcaaccggtcaaatggtatgacgtggatagcataaggtcagcagtcgctgagaaatataacatgagcgatgaagaggtcataaacgaagagcggcagcttttaaaaatgttaagagaaaggcagtactttaagcacgaagtgcttcactggtttgaaggaatttaaagccaggttaacaacaaaatttgagttttcggggagggag

SEQ ID NO: 412 - DNA, 275 bp, Phaseolus vulgaris alphaendornavirus 3
  source 1..275: mol_type = other DNA
caactaaattgcaagtatcacaaattggaagagatggaagtcgtggaatgcttgaatacgctttatcagagaatagaaaaaccgaccacgaggcaagttacggctctgataactagtgagaacataagaaagggcgtcaaatcaatgagcagaatcaaggagctaacaggagattcggaccaatttgaacacaggagactaatagacgactagctaatcgatgcactccaaattaaagtacaccaagaaatcaactttctcgccccccccccccc

SEQ ID NO: 413 - DNA, 220 bp, Persea americana alphaendornavirus 1
  source 1..220: mol_type = other DNA
attatgaaacatggttatgttatcaaaccagtacaatggtacggctacgatacaatgttagcagcggtagctgaaaagtataatatgacccatatccaagtggagggttacctacacaatttattggaaatgatagataaatcgagagtgtacagtcataaatttagagtgtttagcaacaaaccgtaattacgaagttaaagaggcccccccccccccc

SEQ ID NO: 414 - DNA, 260 bp, Bell pepper alphaendornavirus
  source 1..260: mol_type = other DNA
cagaagttatgaatgaagtaaaggttcagaatttaccaattcaaccggtcaaatggtatgacgtggatagcataaggtcagcagtcgctgagaaatataacatgagtgatgaagaggtcataaatgaagagcggcagcttttgaaaatgttaagagaaaggcagtactttaagcacgaagtgcttcactggtttgaaggaatttaaagccaggttaacaacaaaatttgagttttcggggaggaagggccacccccccac

SEQ ID NO: 415 - DNA, 247 bp, Winged bean alphaendornavirus 1
  source 1..247: mol_type = other DNA
tgaagtgcgagaaacagttgcaaacaaaaaattcagcatagagccacttaaatggtatgattacgactctgcagtctacgcaacggcatccaaatacgccattagtgagaccgaagtagaaaacaataagttacaattattagcaatgataaacaatccaatcacataccaaacagacgtgttgcattggtatgaaggtaaataagtgtttctcaagtgtgtgtgtggggtaaggaccccccccccc

SEQ ID NO: 416 - DNA, 200 bp, Cluster bean alphaendornavirus 1
  source 1..200: mol_type = other DNA
gctgtcattgccaatcaaaccagtcaagtggtacgacgttcaggagtgttttaaagcgagcgatgaaaagcacggtgagtacatgggttgcagcgaagattgtgtgtcccagttgtgtaacatgatgattaacccagttttatatgagtacaccatgactcactggagtgagtcacagtgagaagaagggtgcccccccc

SEQ ID NO: 417 - DNA, 262 bp, Oryza sativa alphaendornavirus
  source 1..262: mol_type = other DNA
gataaattagtaaatgatctccaattacccatcaatcccgtacactggtacaattatcacacgatgttacagggcgttgctgacaaatgggacatgaacatacaacaagttgaggggtattatcataacttgatctacatgatatctaaagacgacatttatcaacataactttagaggattcggtaatagatgaatattataactaactctgttttgtcaatttatttttaaaaggatggggcacccctcccaaaccccgg

SEQ ID NO: 418 - DNA, 243 bp, Oryza rufipogon alphaendornavirus
  source 1..243: mol_type = other DNA
gatcaactggtgaaggaattacaactacccataactccaatacattggtacaattatcatatgatgttgcaaggcgttgctgataaatggggtatgaatgtgcaacaagtggaagggtattatcacaatctacttcacatgatatcgagagaaaacatatatattcacagcttcagaggctttggcaatcgttgaacatgattaattatttttaaaagggcggggatccctccccaaccccgg

SEQ ID NO: 419 - DNA, 250 bp, unidentified
  source 1..250: mol_type = other DNA; note = unclassified Endornaviridae
aaaaggtccgaatgtcgaggaaacggtaaagctgttgaacttaccgataaaaccaatagcatggtacaactatgattatatggtaacctctgtggcttacaagtacaatatgacagatgaacaggtgaggggttattatgatcaacttctagcattaattagaagtgaccaaatttactcacatgtgtttagacatttttcgaataagtagtttcttaagaagggttattaaaacccccctccccccccc

SEQ ID NO: 420 - DNA, 260 bp, Bell pepper alphaendornavirus
  source 1..260: mol_type = other DNA
cagaagttatgaatgaagtaaaggttcagaatttgccaattcaaccggtcaaatggtatgacgtggatagcataaggtcagcagtcgctgagaaatataacatgagtgatgaagaggtcataaatgaagagcggcagcttttaaaaatgttaagagaaaggcagtactttaagcatgaagtgcttcactggtttgaaggaatttaaagccaggttaacaacaaaatttgagttttcggggagggagggccacccccgcac

SEQ ID NO: 421 - DNA, 245 bp, unidentified
  source 1..245: mol_type = other DNA; note = unclassified Endornaviridae
cttgatgggtaagacgaaagggacagaaagggtgatcaaaacattaggtctgccaatcagaccaacccacacatgtgacatagctgctgcacggcaggcagtggccacgaagaggaacatgacgatacatgaagtggagggagcagagcatcatctgtacgagatgatggagaaccagcgggtataccactgggaattcctccactacatggacgactgagtattgaaggggttcaccccccccc

SEQ ID NO: 422 - DNA, 248 bp, unidentified
  source 1..248: mol_type = other DNA; note = unclassified Endornaviridae
acccgaagtaatgagagatgttgtcagccaaaaattgcccatcaaaccaactaaatggtacgatgtagactccataaggtccgcagtggcagacaagtacaatatgagtgatgaacaagttttgaatgaggaaaggcaattgctgcaaatgttgcgagaacgcaacagctttaaacataacatattgcattggtatgaaggtgtttagtaataaatagtttgagtttttgggaagggagggccccccc

SEQ ID NO: 423 - DNA, 247 bp, Cucumis melo alphaendornavirus
  source 1..247: mol_type = other DNA
ggtcctaacgttgacgatacggttaggatgttaaacttacctatcaaaccaatagcatggtacaacttcgatcacatggtgaccgctgtggctcataagtataatatgaacgaggagcaggttagaggttattatgatcaattgttagccacaatcagaagtgacaacatctactcacatgtgtttagacatttctctaataaatagtttcttaaggagaggatttttcctctctcttaagaaacta

SEQ ID NO: 424 - DNA, 238 bp, Bell pepper alphaendornavirus
  source 1..238: mol_type = other DNA
cagaagttatgaatgaagtaaaggttcagaatttgccaattcaaccggtcaaatggtatgacgtggatagcataaggtcagcagtcgctgagaaatataacatgagcgatgaagaggtcataaacgaagagcggcagcttttaaaaatgttaagagaaaggcagtactttaagcacgaagtgcttcactggtttgaaggaatttaaagccaggttaacaacaaaatttgagttttcgg

SEQ ID NO: 425 - DNA, 252 bp, unidentified
  source 1..252: mol_type = other DNA; note = unclassified Endornaviridae
accagaagtggtgagagatgttgtcagccaacaattgcccatcaaaccaactaaatggtatgatgtagactccataaggtccgcggtggcagacaagtacaatatgagtgatgaacaagttttgaatgaggaaaggcaattgctgcaaatgttgcgagaacgcaacagcttcaaacataacatattgcattggtatgaaggtgtttagtaataaatagtttgagtttttgggaggggagggccccccccccc

SEQ ID NO: 426 - DNA, 243 bp, unidentified
  source 1..243: mol_type = other DNA; note = unclassified Endornaviridae
accagaagtggtgagagatgttgtcagccaacaattgcccatcaaaccaactaaatggtatgatgtagactccataaggtccgcggtggcagacaagtacaatatgagtgatgaacaagttttgaatgaggaaaggcaattgctgcaaatgttgcgagaacgcaacagcttcaaacataacatattgcattggtatgaaggtgtttagtaataaatagtttgagtttttgggaggggagggcc

SEQ ID NO: 427 - DNA, 216 bp, unidentified
  source 1..216: mol_type = other DNA; note = unclassified Endornaviridae
aagtggcagcgttaataaagcgtaaagggtggaaaatagaaccaatgcgttggtatgatatggactctatagtgtccgcttgtgcttccaagtataacgtgtcagtggatagtgtttgggacaattatcatgaactgattgatcttatgggacaacaacatgtgtatcagcacaattttttgcattgggtagaaaaactataaagatgagtgtggg

SEQ ID NO: 428 - DNA, 233 bp, unidentified
  source 1..233: mol_type = other DNA; note = unclassified Endornaviridae
gacgctgccacaatggtaccatcaagacactgcaatagcagcaaattgtgaataccatggtgaaactgaatgggagacacgagcgcacatttcagcactcagggatatgttagagaaacaggtggccaacagaaaacagataatgacctggagtgcggtgtaacgggttgtctagtcatacaatttaatttcattgcgggagcaaatcgtgagcatgtcggtgcgttgtcttt

SEQ ID NO: 429 - DNA, 251 bp, Bell pepper alphaendornavirus
  source 1..251: mol_type = other DNA
cagaagttatgaatgaagtaaaggttcagaatttgccaattcaaccggtcaaatggtatgacgtggatagcataaggtcagcagtcgctgaaaaatataacatgagcgatgaagaggtcataaatgaagagcggcagcttttaaaaatgttaagagaaaggcagtactttaagcacgaagtgcttcactggtttgaaggaatttaaagccaggttaacaacaaaatttgagttttcggggagggagggccc

SEQ ID NO: 430 - DNA, 267 bp, unidentified
  source 1..267: mol_type = other DNA; note = unclassified Endornaviridae
aaaagaatatgaatggccaatcactactaccacttggtatgaccaactatccaatttgcaagctaatgccgagtataatgaaatatctcaggagcaagtcctcagttacaagcaaaatttaatcgcttacttgaaagaattcaacacctacaaatcggtttattggacagtagacacagaaaaaagataacaaccaaacattggctcatcacctacatcggcacacgttgcaggtgtgagtacaattcagttccgcccccccccccc

SEQ ID NO: 431 - DNA, 238 bp, unidentified
  source 1..238: mol_type = other DNA; note = unclassified Endornaviridae
caattaaaccagagcagtggtatgaacaaaacactctaatccaggcaactgcaaaaatatataacaccgatgagaactatgtaattgacaactataataaactgatgcaaatgattgacaatcaacaaatatttgaacatgaatttactcagtatgaagctagcagaaaaatgtaatctgccaatcggccaagttgattatatttaatcaacttggaaaatagatgtgtgtgtgtggc

SEQ ID NO: 432 - DNA, 250 bp, Bell pepper alphaendornavirus
  source 1..250: mol_type = other DNA
cagaagttatgaatgaagtaaaggttcagaatttgccaattcaaccggtcaaatggtatgacgtggatagcataaggtcagcagtcgctgagaaatataacatgagtgatgaagaggtcataaatgaagagcggcagcttttaaaaatgttaagagaaaggcagtactttaagcatgaagtgcttcactggtttgaaggaatttaaagccaggttaacaacaaaatttgagttttcggggagggagggtc

SEQ ID NO: 433 - DNA, 855 bp, unidentified
  source 1..855: mol_type = other DNA; note = unclassified Endornaviridae
aatgataaagcttaactgtgatttgcacaacatggaggaaatgcagatggtgcaaataatcagcaaattatactcaagcttgcagaaacccaaaacatattcttacactttcctaataacgagcgagaacctcaggaagggaattcgacttaggaaagaaagtgataccctgaacaccaccgaatcccgaattcatcacagactagacgaagaaaatcactaatcatcttattttaattgaacgagcccaatacccggaacgttggaatagccattcctcgtcaagacacatatgccatgcctatgtggcttcacgaagactggtcgttccactttctgtcacctgtaatcgctacgcaagcgccattaatgtgaaccgtggctaattatcagactgctgcgtcatctgtaagtagccattcttcaattactggccgcattgcagtacgagaaacaagcttgacagaaagctggaaacggcaaagtgacgttgagtcactttgtcgcgttacagccgaccagttacgggcatacttattgaacgagcccaatacccggaacgttggaatagccattcctcgtcaagacacatatgccatgcctatgtggcttcacgaagactggtcgttccactttctgtcacctgtaatcgctacgcaagcgccattaatgtgaaccgtggctaattatcagactgctgcgtcatctgtaagtagccattcttcaattactggccgcattgcagtacgagaaacaagcttgacagaaagctggaaacggcaaagtgacgttgagtcactttgtcgcgttacagccgaccagttacgggcatacttattcagtgttataacaggc

SEQ ID NO: 434 - DNA, 208 bp, Phaseolus vulgaris alphaendornavirus 2
  source 1..208: mol_type = other DNA
acctgaagtgacacgagcaatacagcaacaacagttgcccatacaaccaattaaatggtatgatgcggacagtatacgtagtgcaaccatgagtaaatacaacatggatgccaaccaagttttgaatgaagagagattgttgctaggcatgttgcgtgaacccaacagctttgcacacaaaatactacattggcacgaaggtcaatag

SEQ ID NO: 435 - DNA, 235 bp, Basella alba alphaendornavirus 1
  source 1..235: mol_type = other DNA
tttagacataccaattaaacctgtagaatggtacagttatgaagacatgatcaaaaccgtgggagctaagtatgaaatgaacgaatatcaggtggaaggatatttgcacaacttgttgaacctgttaaaatttaaagaatattattcacacaagttccgtatgttcagcaataggacaggtacaaaactatactaacgttttgatagaggtttgaaacctctaccggggcccccc

SEQ ID NO: 436 - DNA, 247 bp, unidentified
  source 1..247: mol_type = other DNA; note = unclassified Endornaviridae
gtaaaggtcctaatgttgacgatacggttaagatgttaaacttacctatcaaaccaatagcatggtacaactttgatcacatggtgaccgctgtggctcataagtataatatgaacgaggagcaggttagaggttattatgatcaattgttagccacaattagaagtgataacatttattcacatgtatttagacatttctctaataaatagtttcttaaggagaggaaaaatcctctctccccccc

SEQ ID NO: 437 - DNA, 261 bp, Oryza sativa alphaendornavirus
  source 1..261: mol_type = other DNA
ataaattagtaaatgatctccaattacctatcaatcccgtacactggtacaattatcacacgatgttacagggcgttgctgacaaatgggacatgaacatacaacaagttgaggggtattatcataacttgatctacatgatatctaaagacgacatttatcaacataactttagaggattcggtaatagatgaatattataactaactctgttttgtcaatttatttttaaaaggatggggcacccctcccaaaccccgg

SEQ ID NO: 438 - DNA, 260 bp, Oryza sativa alphaendornavirus
  source 1..260: mol_type = other DNA
ataaattagtaaatgatctccaattacctatcaatcccgtacactggtacaattatcacacgatgttacagggcgttgctgacaaatgggacatgaacatacaacaagttgaggggtattatcataacttgatctacatgatatctaaagacgacatttatcaacataactttagaggattcggtaatagatgaatattataactaactctgttttgtcaatttatttttaaaaggatggggcacccctcccaaaccccg

SEQ ID NO: 439 - DNA, 241 bp, unidentified
  source 1..241: mol_type = other DNA; note = unclassified Endornaviridae
cgccagtagcacaaataattaacagcaatggctggcctattgaaccacatgagtggtattcaacggctgagtgttgggctgctgcggaaagattgaacgggttggaatggggtgatgcggaagcacacataaacaaattaatagatatgatggccaattttaatccatttgacagaaaaattctacattggactgaacgctgggagtaagaagggaggagcaggtgaggggcccccccccc

SEQ ID NO: 440 - DNA, 260 bp, Bell pepper alphaendornavirus
  source 1..260: mol_type = other DNA
cagaagttatgagtgaagtcaaagttcaaaacttgccaattcaaccggtcaaatggtatgacgtggacagcataaggtcagcagtcgctgaaaaatataacatgagtgatgaagaagtcataaatgaagagcggcagcttttgaaaatgctaagagaaaggcattattttaagcacgaagtgcttcactggtttgaaggaatttaaagccaggataaaattaaaatttgagttttcggggagggagggcccccccccccc

SEQ ID NO: 441 - DNA, 238 bp, unidentified
  source 1..238: mol_type = other DNA; note = unclassified Endornaviridae
ctccggaagtgatgaacatggtcaccatcaatgggtggcccatagaacccttgagatggtatgacgttgacaccactatacaagcttgtagggacaaatacagcatggaggacaatgaagtgtacaacaattatcatgaattaatacaaatgatgaacactatgcgcacgtatgatcatgacttcttgcattgggaggaaaaatggtaaagattgaatgaggaaggcaaagccccccc

SEQ ID NO: 442 - DNA, 244 bp, Hordeum vulgare alphaendornavirus
  source 1..244: mol_type = other DNA
acaattgatcaaggagaggggttacaccgtagagccaccaatgtggtatgactggaactccaatgcaagagccacagaggacaagtaccactggctaccggggaaaagtgacacagagctgcgcatgctgctggatatgatgagacaaacaaactacatcgatcacaaactgttgcactgggtggaagctacccgctagtgctcctacccacgttttggtgacgaacaagattgccccccccct

SEQ ID NO: 443 - DNA, 244 bp, Hordeum vulgare alphaendornavirus
  source 1..244: mol_type = other DNA
acaattgatcaaggagaggggttacaccgtagagccaccaatgtggtatgactggaactccaatgcaagagccacagaggacaagtaccactggctaccggggaaaagtgacacagagctgcgcatgctgctggatatgatgagacaaacaaactacatcgatcacaaactgttgcactgggtggaagctacccgctagtgctcctacccacgttttggtgacgaacaagattgcccccccctc

SEQ ID NO: 444 - DNA, 252 bp, Cucumis melo alphaendornavirus
  source 1..252: mol_type = other DNA
taaaggtcctaacgttgacgatacggtcaggatgttaaacttacctatcaaaccaatagcatggtacaacttcgatcatatggtgaccgctgtggctcataagtataatatgaacgaggagcaggttagaggttattatgatcaattgttagccacaatcagaagtgacaacatttattcacatgtgtttagacatttctctaataaatagtttcttaaggagaggaaaaatcctctccccccccccagatt

SEQ ID NO: 445 - DNA, 235 bp, Phaseolus vulgaris alphaendornavirus 1
  source 1..235: mol_type = other DNA
tgatcagagagctagaattgcctattaagcctgtcaaatggtataattatcattgtgccctaaccgcagctggacacaaatatgacatgcacccagaccaggttgaaggcaccttacatcaattactgcacttaatcaaagaagggaaattgcacaagtacacgtttagattatttgaaagtgggaagcatcattaacaatgatgtgataacatgaacccgaacggttccccccc

SEQ ID NO: 446 - DNA, 240 bp, Phaseolus vulgaris alphaendornavirus 2
  source 1..240: mol_type = other DNA
acctgaagtgacacgagcaatacagcaacaacaattgcccatacaaccaattaaatggtatgatgcggacagcatacgtagtgcaaccatgagtaaatacaacatggatgccaaccaagttttgaacgaagagagattattgctaggcatgttgcgtgaacccaacagctttgcacacaaaatactacattggcatgagggtcaatagcttgaattttcggggggtgggggccccccccc

SEQ ID NO: 447 - DNA, 259 bp, Bell pepper alphaendornavirus
  source 1..259: mol_type = other DNA
cagaagttatgagtgaagttaaagttcaaaacttaccaattcaaccggtcaaatggtatgacgtggatagcataaggtcagcagtcgctgaaaaatataacatgagtgatgaagaagtcataaacgaagagcggcagcttttgaaaatgctaagagaaaggcaatattataagcacgaagtacttcactggtttgaaggaatttaaagccaggacaaaattaaaatttgagttttcggggagggagggccccccccccc

SEQ ID NO: 448 - DNA, 246 bp, Bell pepper alphaendornavirus
  source 1..246: mol_type = other DNA
cagaagttatgaatgaagtaaaggttcagaatttgccaattcaaccggtcaaatggtatgacgtggatagyataaggtcagcagtcgctgagaaatataacatgagygatgaagaggtcataaaygaagagcggcagcttttaaaaatgttaagagaaaggcagtactttaagcaygaagtgcttcactggtttgaaggaatttaaagccaggttaacaacaaaatttgagttttcggggagggag

SEQ ID NO: 449 - DNA, 246 bp, Bell pepper alphaendornavirus
  source 1..246: mol_type = other DNA
cagaagttatgaatgaagtaaaggttcaraatttgccaattcaaccggtmaaatggtatgacgtggatagcataagrtcagcagtcgctgagaaatataacatgagcgatgaagaagttataaatgaagagcggcagcttttgaaaatgttaagagaaaggcagtactttaagcacgaagtgcttcactggtttgaaggrrtttaaagccagkytaacaacaaaatttgagttttcggggagggag

SEQ ID NO: 450 - DNA, 244 bp, Helianthus annuus alphaendornavirus
  source 1..244: mol_type = other DNA
gaaaacaatgggaaccaaggctgtggtgaccaagcatgggttaccaatagatttaaaaaccacctgcagcatggcctcagctagaagagcttgtgcgattaaaaggaagatgactcttggagaggtggagagttacgagagttatttatacagaatgatgaaagacctcaaaacacacacctggatttttaaacacctagcgtgagactgcaagtagagaattggagagggatttccccccccc

SEQ ID NO: 451 - DNA, 246 bp, Bell pepper alphaendornavirus; identical to SEQ ID NO: 411
  source 1..246: mol_type = other DNA

SEQ ID NO: 452 - DNA, 264 bp, Lagenaria siceraria alphaendornavirus
  source 1..264: mol_type = other DNA
aaatgtgaaggagacggtcacaaaattgaacttgccgattaaaccattagtctggtatgactttgaatccatgttaagggcggttggagacaaatatgacatgtctcatgtgcaggtgttagatgtgtattataacttactacaaatgctaaattccgagaagttgtataggcacacatttagacatttttccaacatagaaggaaagtaatggaaggaaggataattttttgaggaaggtgtatagaacaccccccccccccc

SEQ ID NO: 453 - DNA, 234 bp, unidentified
  source 1..234: mol_type = other DNA; note = unclassified Endornaviridae
acccgaagtgatgagagatgttgtcagccaacaattgcccatcaaaccaattaagtggtatgatgtagactccataaggtccgcagtggcagacaaatacaacatgagtgatgaacaagttttgaatgaggaaaggcaattattgcaaatgttgcgagaacgtaacagctttaaacatgacatattgcattggtatgaaggtgtttagtaatgaatagtttgagtttttgggag

SEQ ID NO: 454 - DNA, 252 bp, unidentified
  source 1..252: mol_type = other DNA; note = unclassified Endornaviridae
ctacagcaaacttaaagaaatggaattcacggatctattgaattcgttatacaatagaatacttaaaccggaaactatacaagtaaaattcctaatcacatcggagaatataagaaaaggaatcaagaagatgagccaagtgaaaagcagtgatcatgaaccggagagtaaatgccacgtgagattgacggttgacgctgattaacaggactggaaaataatccgattgcaaaatttctctcgccccccccc

SEQ ID NO: 455 - DNA, 310 bp, Oryza sativa alphaendornavirus
  source 1..310: mol_type = other DNA
gacagactgaaaactttactgatagatcatatactttacgtggatggattgagaccagatgaaatatcagccaaattaagacaaatatctgatgtatttggattctttgaaaacgacctgactaagcaagatagacaaactgacaaaccaattttggaagtggaaatgttgatgtatctyatgttgggagttcaycctaacatcatatctagttggcgttcaagtcatgatgattggagattcaaatctacaaattattggggtaagagcacagcaatgagattaacgggacaagccacaactgcactag

SEQ ID NO: 456 - protein, 103 aa, Oryza sativa alphaendornavirus
DRLKTLLIDHILYVDGLRPDEISAKLRQISDVFGFFENDLTKQDRQTDKPILEVEMLMYLMLGVHPNIISSWRSSHDDWRFKSTNYWGKSTAMRLTGQATTAL

SEQ ID NO: 457 - DNA, 473 bp, Oryza sativa alphaendornavirus
  source 1..473: mol_type = other DNA
tggcaaataaactacaaactgctttcctttgccaaattgtttgtaanatgcaangacagactgaaaactttactgatagatcatatactttacgtggatggattgagaccagatgaaatatcagccaaattaagacaaatatctgatgtatttggattctttgaaaacgacctgactaagcaagatagacaaactgacaaaccaattttggaagtggaaatgttgatgtatcttatgttgggagttcaccctaacatcatatctagttggcgttcaagtcatgatgattggagattcaaatctacaaattattggggtaagagcacagcaatgagattaacgggacaagccacaactgcactaggaaattgtattactaatatgcaagtacactcaaaatttgtaatcaaaaataaatattggttaaagttkgctttatttcttggggacgatatgtgtatgggtttctcaca

SEQ ID NO: 458 - DNA, 854 bp, Oryza sativa alphaendornavirus
  source 1..854: mol_type = other DNA
aaacacagatatngtcaaagataatccagaagatgacatggtgaacgatgacttacccactgttttaaccatacgaacaatgcatactttaagaaaacaagacattgataaattaaatgaacttaktattgttcagcargggcattcagtaagttatttttacattcataaaaatcacataagctgcaatttgaaattcatgggtaaacgtgtggcagaaataataaacattgatggaaatgtgactgtaaatggaccttggtattataaacgcaaaatattagataaattagatgaaaaattggacttaaatgatgtaaaaggcataactatatgtccaagagggacaaaattagtgagaatcaaaaccaatcaaaaatttagaaataaggtaagggaattagcctggatagtagacaaatgctacgatggtaaattcactatcaaaataaataatatcattataactataacaaagaacgcaggttgtcctttatttagtggattaaagttcaggacaaagaacgaatatttcgagatttgcaaactgaaatattttagtttgagaagagaattaatcatacataaatcgcataattatagagaattgagttgtattttaaagtggttggacatagattacaattctattaactatgatgatgaagtggatattggttggctaaaaaccatgactggacataatataagctcatggagacaatacaaggaaagattatctagtgtcagtytatggtttattaacgcttgtttcgacagtacatcccgaaaatgtmaagagttaagtgatcgtaatactgccatatataatagatacatgttaacagaaaaca

SEQ ID NO: 459 - DNA, 473 bp, Oryza sativa alphaendornavirus
  source 1..473: mol_type = other DNA
tggcaaataaaccacaaactgctttcctttgccaaattgtttgkaagatgcaangacagactgaaaactttactgatagatcatatactttacgtggatggattgagaccagatgaaatatcagccaaattaagacaaatatctgatgtatttggattctttgaaaacgacctgactaagcaagatagacaaactgacaaaccaattttggaagtggaaatgttgatgtatctcatgttgggagttcatcctaacatcatatcyagttggcgttcaagtcatgatgattggagattcaaatctacaaattattggggtaagagcacagcaatgagattaacgggacaagccacaactgcactaggaaattgtattactaatatgcaagtacactcaaaatttgtaatcaaaaataaatattggttaaagtttgctttatttcttggggacgatatgtgtatgggtttctcaca

SEQ ID NO: 460 - DNA, 13893 bp, Oryza sativa alphaendornavirus
  source 1..13893: mol_type = other DNA
gtttaaaagggttgggggatgggatgtaagtgaaatggatatagatgatatggtgggatgtatgggatgggattttgccgggtttgggagggggtgccccatcctttaataaattaattgaacagagttagttataatattcatctattaccgaaccctctagaatatgaatgatgtcgtctcgatgatatcatgatcagttggttaatacccttcttcctgtatattcatgtccacatttgtcagcgatacaccctgtcatcgtgtgataattgtaccagtgtacatacgggattgataggtaattggagatcatttaccaatttatcaacctcaggtgtttcctaacatcatcaagtagatgccttgcgcatcaataagttctctttcgttgccttggtacgccattggtaacttcatacctaaatttcatcctgactacatctggcccaattcttacgttatcattcgttttgtaaaccaccatgctacagagaacgttgctccattagtcatccaagaaaatctttgcttttgcattaaatttacaagctatatcctggcgtgatgatgtgcattggcttggtgaaaaacccatacacatatcgtcctagataaagcaagaaaactaaccaattattttgattacaaattttgatgtgtacttgcatattagtaatacaatttcccctagtgcagttgtggcttgtccctataatctcattgctgttgagtgtgctcttacccaataatttgtgatcgatttgaatctccaatcatcatgacttgagagcaccaactgatatgatgttaggatgaactcaacatgagatacatcaacatttccacttccaaaattggtttgtcagtttgtctatcttgcttagtcaggtcgttttcaaaatccaaatacatcagatatttgtcttaattggctgatatttcatctggtctgatccatccacgtagagtaacgatatctatcagtaaagttttcagtctgtctttgcatcttaaacaatttggcaaatagactacaactgctttcctttgctatactattattctagcttgctgttccttcataatggagatatgtttgtcctttagaaactccaactttaaatgaacattaacatcatttaagattgattaataattcgcctgctagtaaatcatttaactcttttcagcaccaaacaatctttattttcttcgatccaattttgacatcttcgggttatgattaataaatcatttttaaaatgcggtatattgtgctcccatctgggtttaaatagttgcattgcacatcccaaagtattctcaggatcaggttcaggtgtaactgttcggtgttaactacggaaaacaatctaccggtatgcggaagcgtccttcctcaaaacatatttttgttagtgacaggtctagattaattggatattttgtcattgtgattttttccatgttgataattttaccgggtagttcacgactcttgattacagtttattggatggagcatacatattgagccaatcaattcagttcaaatctgtatcagtccataattgcataaagctatatcaggcatatcaaacaatggctctatcacacagcagtataattcatagtgatgtggtgcaatgtgaatcaaacttggttcatagtttgcgtagtattttacatttttaattgacggagaatcttgaacgtcatttattttcatatcatttaattgcttgacgtccagcaactgatttgaaatgtttttcttttcagtgatggtttgacattccacttatcgtcactttaaaagattgatttttatcttctaatttccatccaattctgtcatctgatttgcacctcctttaacactctttgttattatcatctcacaacaaggaggtatacttaatgtatcatctgataagcaaatgacatctttactgtcatttagtttgcaatttgttttgtcagccaagactgttatttcacagtgtcttcttcttttaataaatgtagtcaattgcgggttacttgatcgggttctatttcttgtttcgactgaactcatctagtaaatctgtactgatatttgacagggcgatcctcataaatagaactctagtgtgtatgtacttttgaccactattttgtatttgttatgttagttcatacatcatttgacccaatctaacgtcggtgacaacactatttccttctgagataccattagttagtgacaagacaatctagcactattaccccaattgaattcatgcaatatttgtattacccattttattatcaatctttgatgaaggtttattgtgtgagctaagatatcgttgaagatgtgagatttccggcgtgctgtaaatgaccagtttgtttgctctcttagatacccaatatcatcacaattgtgagtgttcgattatcaaagtcagccactattctagaaaacaaacttatttacttaaatgtggggagtgcagatttcattagatctaattaatggtttgtttatttcattgaatacaatggtttgtttagactgacctcagcgttctttgtcatcaatagttctgcgatatattttgggtattccagatgtattgataattacgactggattttcacagaatgtccgtacacaattaatttattcatgaatatttcaaaattcacaagttgcagccaaccatctttgcagctattgcaataaccaatacctaatgctttatcattatggtgagtatctcctatgcgatcccaaatacacatatgcaattgtgacgtgcagttgttgcctggcactcaaaactatgcaaacttatggatctagttcgggtatgtaaaatttttaaccatttattggcaataaaacatcatcacatgaggattgcatagttccatactagtattgtaatgttaatctgtttgatatatatgatttgcaattccttatctctttgataggcgcttacagcagggcttctacttagagaagactgtcttgcaacttgatattttgatcaatacacaatgcgaatgccaccgtctcctattttaagatcacgaatcggtcctggcttgagttcatcacacgaccttgtttctttaactccaaacaatataatttaccctaagataataaaccatcttctagttctgattctgttacctggtttaaaagaattggatatactgagactggcaagcattattgcatccataatgaaactattgaggcatgtttaatgcactctcttacacaatggctttgagtgggattcattaattcaacatccactatatcatctattttacataataaccaaggtagattggtgctgaatctgccttcaaaattctttatttttgtatcaatcctgcttgtcgtaaagcgtttgggtatattctccaccgtgtaaatctttaagggttcaagtagtttgattaaccccgaattatttgttcatttagcttttgcatcctttaacttgtgactgcttgctttggctaaagccataacagatgtcaagtcttctttagtgtaatttctatttagtgaacaaccaattctatatttgttctaatttgtaaatgccctttagaaaattggcaaatattttgggttgcacaaccgtaaacattcattgaatagactatctaacactgtaccgtgcctaccatgacaaactgttaagaacactttaccatacatttccgagcaattgaaatgttttagtaatattattttacctgaacattcttcaactatttgggaattctgtcttgatactcgtgattcgtgcaacttatcataatatggtatcataactcctaaagagcagatgtcctctgctaatttcatacatgtactttgacatcatttggtttgtgcaactacttgaaattttatgaacacactgttatttggtattttctaatcccaaaggttgctggaaaccacttaacatattcagcggtccgacaggatttttaatcttataattagaaacatccaaggtagacaattagtcattgatataattggtctttgtttctcacaataccttgacctattaaaattggcaatggcatattccagattatagaactttccaataaattgttgtatccaaccacacttgttctattaagtggtgacatcatttaaaggaaacgttccaatactccatttcttaccaaatatctggctgtaatttttatagataaaatgaatgtgtggtcacgacagtgcagttaaaatttttatacatattgaccaattcatttcaagaacataccatcttcttttaattgatttaaactaccagacaggcaactagaccatcctttttcagaaaagttcatagccaatcaaatgtttcctttgtgtctattccaagtcgaaaagtcatctttatttacaaaacttgcaaattttccttgtgggtgaccaaatgatcctcgtccaatcaaatatttatatatttaatatgggtacaaaaaccaaacttccatgatattaaaataatcaatttgtttctttgtcaaggtccatctcttctgaatctattttctttaattcttaggtgccaatttgccaagataaatgggttatatttttagtggttaccgtgtatcagcatctccatcacactacctttctcgaatttattactgtaattatcaataacatcttccgcattgcacttattagatttatgacagggactgttatttctgaagattcatgccaagaacgagtagataaaatgtgccacgttcgaccagaatctctatcgcatatttccccatatagcagacatttgattttcattgatatgacagggttcagttttaaggaagtcaattattctttgcaaaacgtaaacccataagtaaaatttgccataatctccctgccaatatggcggtatgagcattggttttgaatttgcttttatcaaatctaacaattgttgtatctccagataaaaataacaaattcatttgttaatctgaaccatttcatgtaatatttttatttctagtggtgcaaatcatcacacacccatttcatatttcattttgtcgactcccctggcataacctaactgaaacaaacatttactctcatggttcactgctgctttaattaatggcatcagagattcagcacaaatactactcaaattcaaccaaactccgtaattggataaacaataacatcttaaccagtcagatttggcttgtggagacatcattgtttagtatcactggagtcaaatatactatgtacgttccctaagttattgtcagttagtatctactattctaaatttcaagggttatacttttgccaagatctaatacaattgcgtaagaatggacttatctccagatccttgccaaataactccaaattattaaaggaacttctccaaatgccccttgaacacatataggtgggtaaagttgtgataggcttagtttagtctgtaaatgaaatttttgtgtaacatcatcggatggtaataatttaatcttctcattgtatcagggtcggtggtacggatttttgatcatatcatagtcggcttctgtggcatagcctttttggtcatttttccaaggtttataaacaacacttcttgacaattgttgattgtccctgtcaacctcatcgtcaacaatcctgagacttccaaattgtctcctagttccttgccatactctaatttttcctgagtattttctaaatcagattctcatgagttgtgacagatccttgatcacaagaagaatccctctctaataaagtttttgtgtttatttatatctttatctggagtatgtcatattatccagcataggcatattattgttgctgggtgtttaaaagaaaagttccaaactttcaccctttgttttcttgtatggcccagttagtatttttaaatcacccataacattctcaaattagtaaggaaactcctatcaaattgtaaatacttcatgcattttccatatcagttatattttctgctactatccctacccatttcagaatgcctggaataaattgttgtagtaaggtgaataaaacttctcatcttctcccaaattaattatataggtgaaattatgtgttcaaatttatataaagtaattatgatgtacatacaaagcaaaccatgtagcaattcattgtaacatgtataatttattgacaaaacctgaatacctttatcagtgatcacttgtgtagattgcactgtcctagcatatgctaataagctatcttctgaatcatcccctgtcattaaccttaataatagatccttaataagtttattgttcgttgttcaatttcttagtggttataaatgttctagttctctatgtccatagatttgtgtgttgatccacggcacttttacatcagtagttgtactgttagcccaatcttgtggcgtgactttggtgactcttgtactatttgggaattttcgtttctagtaaatttatcagatacattctcgaaataatcgttgatgaattgggtggtctttaacgtacattactcatttgtttgtaataccctcaatgggttaccgttttgaattttaatagctagttgatttttatttgattggagtatttcctctccatgataataaattttatttctcctctgttgctaatggaataccacttggattgattgtcatccattaactaggtcacccataaataatcacaattatttagttttgttgaatattccactgttacttgatctagactcactccagtaatatcaggagaataacccgtcaaatttaagctaacctatgtgatcataccttcataaatacatgaactaatgcattaacaattggcatttcgatcataaatcttaattggggatttttcatctggtatctctaatgatacataaatattttccttgtatggcaacactgctaggactttactccaccataaacaactatttgaggattgtgtttgcttgtcttagcaatgtattcaacattatttgttccagtacctattatcaccagaatttagcagattataatttcctctatttgaattgtgagttttggatacctagctagtatagctgttctgaattcatcattgtcattaaacttaatctgatgttatcgtgaatgccaggactagtcaataatagtaatttatttatattggtgccaataatttgttttatctccgtccctaattgataatgtttcttctagaggtaaatataaacctggtatgtctagtgccaacccgcttgttccttaattcaaatcgctttatccatatctaataaacattcttcttacaaattgtctccagagtgtttcatcagatccttcctttacaattaatattaaatcatttttgttaaacatattcattaaacgtttcagttctccataaatttaaagctcctttcagtggttttatattaatttgtatgtcgaattagggactgatggaactcattacatcaactccctgtttgttaacatgtatctattatatatggcagtattacgatcacttaactcttcatcttcgggatgtactgtcgaaacaagcgttaataaaccataaactgacactagataatcttcctctgtattgtctccatgagcttattatgtccagtcactagttttagccaaccaatatccacttcatcacttagttaatagaattgtaatctatgtccaacactcaaaatacaactcaattctctataattatgcgatttatgtatgattaattcttctcaaactaaaattacttcagtttgcaattcgaaatattcgttctttgtcctgaactttttaatccactaataaaggacaacctgcgttcttctgttatagttaatgatattatattctaaaagtatagtgaatttaccatcgtagcatttgtctcattatccaggctaattcccttacctattttctaaatttttgattggttctgattctcactaattgtcccttcttggacatatagttatgccttacatcatttaagtccaatttcatctaatttatctaatatttgcgtttataaatcaaggtccatttcgcagtcacatttccacttacatcgttgtctattattttatccactctacccatgaatttcaaattgcagcttatgtgattttctcatatgaatgtaaataacttactgaatgccctgctgaacaattatggttcatttaatttatcaatgtctgttttcttaaagtatgctgttcttcgtatggttaaacagtaggtaagtcatcgtttccatgtctcagttattttagcaatatctgtgttttccaattattttcatgtgggcgccacctacattactgacataaatcgcttactgtttgtatgttggatattgggtagccgtatactattatcacaatggtgcttagctctagttaacgctgaatttaaatacaaagcatttccgttcaatcccacttgccggttctatctagctctctgagtatcactaaagatttgttaacttttcttgtccttgataactatgcgtggtcaacaggtattgtgacatatccgtcattctcaattctctgtctattataatatatatggagttataaacaccaggtttacatcgatgctctatgaccggcaatttttcaaatcttgcatccaacacagtctcgttatatgttgtttgtgatctgccgcaatgatacgagtttgggttctattggtcttataaaagtggcaaggctttcaccgattttgtaagttgtataaaatctacatatctgattttctaacaataatactgtaacactgtaatatgtacttaaaaccaggttggacttcatgtacattgtcccttatttggctctcatcggccatatctcctcattaaagtagttgtgggtctcataataacgctaacttcaaccaatcaatcatatagtcgccttccatctacaaatatatggtgttgacactcatcatacttggatgaggctttttccaaggagcatactgatgtgtttatcctttgttctctcttatgctcattcagatgatctggtcatagcaacacataatcaccgtgtgttatagctctagataacatagttgatttgccatatcccgtggccccaacgtcaattagatcttttcaacactttctgaattctgacatagtaatatgttcagcactttaggctgactaatgatttaatcgcactaccagatgactctttaagcattatgaccttgaattctttgctttcactgtaaagctccagattgataacataggatcacctctcactgaaattggtgacttcacttatataattgttttctaccttgtttaagcacaaggtgtcgaatttcttcaacttgtgatattgaactttttgtcaaacattattttagctcctaccatacctagaattcatgacattctttgtgtccttgattaatttggcatcactaatttatcgttgaacatagaatttattctagaaaagattctcaaaacctctatatttccgttatttcacttctaacattgggtaattcagaacttgtgtcacatttcatggggtattctgatatttttagagaaccttccaatgctgatgttattttatccactaaagtactgtattcctttgtatttctatatgtatgagattggtctcccatttcaataatttgtgtcaggattatacttatgtacatttcccgtctatttcatatactgcatggaaattcgatatactgtttgataaattttcagatatgcaaattgaattaatcacatatattctttcatctccagtaatatcagggctctattgcaatgattgtgaggtccagtctcgattgtataattttattcctgtttgctgatgcttggtttaggtcatgctctaataagtttcctcctttctctaattctgcgaattacacatggagaaaagtgacctatttctgttttgtactgtgtcaattaacttttcattttcatcaagtaaggtaaatcgtagtgaatacacatgaattttatcattcggggttgtatttcccaacgaatacccctcttggttctaccataattattaattccaagatcaaagctaagtccattaaggccaagtcggtttaccaatttttcttgtcactgtaccagttattgaaacaaaatcagtccaaggtataggcttatcagtgcataattgaacgttcatatccgcaagaattaaagcttggaattaggtaatgaaatttctctattcttcaaatttcgtcttgttgccaagctacgaatccaactggaatgcgtaaatgatatctcactgttgagtgctcaccatttaatctggattcaaattctcaggatcagttacatgagcataaaaatcaacttcaattctggttagaacttttctttattatcagcagatcaacaaatcatgtgcctcattcgataatttagtaatttcttacgcacacttggaactatctttgatgcaaatttagaaacatctgtttccagctttctccggatagatcagtagaattatcgcttctgctggtgtttttagctatctcaatttgaagcctatccggttgctttgaagtcttggtgtttatccgtcaattctataaattttttgtatccttactatcatctactttgtgtactattaatgcttcctcctggttagcaccactatcgatgtcgtcaatgatttggatttctcgtatcttcaactagtaacgtttgaactctacatctaaattgcttactgacacaacatgtttgccttcttctataacttcatttattgttttggttggtaatgctttgttgatcgggcatttcggtaacatctgttttgacaggtcttgctgctgtaatctgttgatatttaacagtacataaggcttggattttataggaggccatttcattcgtcatgacttattttagatttgattgtactctagctttagattctaattctcaatctaattataattttcaccctcgtcatctactttctaatttgcttccatcaatttgaaaagctgttattggggtcgtccccttcactcattcgcaataatccaattctatcgatataccacaacctttcatatatgttctgttaaaagcaaaccatgctcacaatttgattatgatggaagcatctctcaatgttattagatattatcacagtgactgtcacccaaatttctaacagtgagcctctctgtagtaatacctttgcttaatttagtaaagctgaccataatgattgtcatgtaatttgttatgaaaagctgaaaggtgtgtgctttctctaaaactctcataatgtctatttcagtaatgctgaatctatcagttatgtattctatgagagcatttattacgtatctagtcgttaaaccttccaattcctttggcatccacctgaggtcctaaaaatactttgtttttcactatagttcaaactaagatcatattccatttttaattgcatcatacaaatatctgataacatgacatgaatatttatcattcatacttcactaggatttgaaaccatctattgtgaactaacaattttgaaggcaataaccaacggcgtattgtacatcaatgtattgtgagatacttacggacaaattcctcgaaggcataaatacttaaacagagatgtatgtaatgtgaatgaaataggtctgaaatttaaaccaataattcttcccaaagttgagtctaaatcaggtaaagatatagtggtagtgatgttgtcatttctgacaattttgtactacgcaggcaatgaattagcatcaatgtaagggcccagtatgcaaacagtgctgcataactctaaatcaaacaccttattgatgacgtagtatttttccgttgttactgtagcattaagttaagtgtttctaatgtatcagtttgaccagtaacgggttagtacatccaaccaagaatatctagtatcatccccaagattattgtaccagaacattatcccttaaacgtttgtctcaacctaggaatgattgcgtataattgacgttgtttattgacaattccctagtatttgggataaactcagagccaatgctcccatacctaagaagcacgtgaatttttcattatgatattgcaacaattgtactacaacacccatcgaagttgtttggttcgaataaccagtcattatatttccattgatggaatttgctatcatcagtttcggtagtaaatttcctatgcaggcaatagcatcacggatttaaatgtgattttatttcacctctactctgcaattgactttcgaaacaaattctggtttaacactattaaaccgctatcatgtctaaaatttacaccctcaacaactttcttaacgttatcatttattatagaggatccaaattcttgacctacaattttacgattctttttgtaaatggaaaaagtattcgttcaccaatatttgtgttgcctgatgttctttatctgtgttttaaatcatcatagtatcagtataccccaatttcattaaattttccaaatcacccatcaaacataagctctctgttattattacatctatatcatcgtttagctcgtctgaactcctcaatatttccaagtttaaatctgtgtatcatacgccacatttccaggaatctctttcattatttccccatcattgacctttgtttcaaatttaacatcaatggttttattatttggtaatatcgtttatgtaatgaacaagttttcattctcctagggatttgagtatatgcattgtcatgaacataatggacaaacttaatgggaggcaatttgccggataagattcataattcaatagaattatcatcttactcatagttcctttaattctcaaatccatcatttacttccttgaaattggtgatttgatggtacataattaaacaatcctcaatatttcgtgaacttttaaagtttttaagaattttccgtgcaatttccttaccgaatggcactatttgaaaatactccttttattcatacatttataaatcccatgtctagatccatttcttcaaaatcttcttcaatcttcaattatttcaggtttcttttaattaagtggctttgttttaagcacatcatccttactaactgtgggatttaagtaaatttctgctcctttgacataattaataataatttagttcaggccaaatgacattcttaacgctaaatttgctcaatacaatcatcatttggagaaaaggattgagcaatgccataatgtcgctttttcaattgtaactttccctcatagcttctacacactatactgatctctttgcaaagtcgaatatacctttatcagtgttcaaataagttatcaaattatcaatgaattgttctgctcatccctacaatggacattcgaggcgctctgaaccaacctaaataaaggatctaatgccgttgtaccctctaagtttggacgctgtatatcgtccattctttcaaacccttcaatagggtttgatttgatcaagatcgtacttgatttgatcatttttattttagaagggcgtccgccccccctgttgttgctgcgtttaatacataaatttgaaatgtcttgtacgacatcaaatccccacccatctacttactcccaccatttcatcttcatatccatttttacatcacatatccctcctacaccatcctctctcataaactcaaaccact

SEQ ID NO: 461 - DNA, 13959 bp, unidentified
  source 1..13959: mol_type = other DNA; note = unclassified Endornaviridae
ctcgtacaagacatttcaaatttatgtaaattgaacgcagcaacaacagggggggggcggagacgcccccccccttttaaaaataaaaatgatcaaatcaagtacgatcttggtttgatcaaatcaaaaacccccattataaaagggtttttgaaaagaatggacgatatacagcgtccaaacttaggtacaacggcattagatcctttattcggatggttcagattgcctcgtaatgtccattgtaggatgaacaaaaacaaattcattgataattttgataacttatttgaacactataaaggtaaacaatttcatgcttgcaaagagatcagtatagtatgtgtagaagctatgaggggagagttacaattgaaagagcgacattatggcattgctcaatccttttctccagatgatgaacgattgagcaaatttagcgttaagaatatgtcatttggcctggtgactagattattatatttaatttatgtcaaaggagcagaaatttacttaaatcccacagttaatgtggatgatgtgcttaaaaacatgagccacttaattaaaaagaaacctgaaataattgaagaagattttgaagaagaagaagattttgaagaaatggatctagacgacatgggatttatagatgataaaatagaagaaaaaggagagtattttcaaatagtgccgttcggtaaaggaaattgcacggaaaaattcttaaaaactttaaagttccacatgaaaatatttaaaggattgtttaattatatgtaccatcatatcaccaatttcaaggaagtaaatgatggatttgtagaaattaaaggaactagagatgaagatgataattctatgaattatgaatcttcatccggcaaattgcctcccattaagttttgtccattatgttcatgccccaatgcatatactcaaatccctaggagaatgaaaacttgtcattacagtgttaaacgatattacccaaataataaaaccattgatgataaatttgaaacaaaggtcaatgatggggaaataatgaaagagattccctggagatgtggtgtatgttacacagatctaaacttggaaattgaggagttcagacaagctaacattattatagatgtaataataacagagagcttgtatgttttgatgggtgatttggaaaatttaatgaaattggggtatactgatacttatgatgatttaaagaacacagataaagaaaacatcaggcaacacgacaaaatattggtgaacgaatactttttccatttacaaaaaagaatcgtaacagtaggtcaagatttggatcctataataaatgataacgttaagaaagttgttaagggtgtaaattttagacatgatagcaagtttaatagtgttaaaccagaatttgtttgtgaaatgtcagtttgcagagaggaaataaaatcacatttaagatccgatgctattgcctgcataggagatttactaccgagaactgatgatagcaaattccatcaatggaaatataatgattggttattcgaaccaaacaacttcgatgggtgctgtaatgacaattgttgcaatcataatgaaaaattcacgtgcttcttaggtatgggagcattggctctgagtttatcccaaatactaggaattgtcaataaacaacgtcaattatacgcaatcattcctagggttaaagacaataaacgtttaagggataatactggtacaataatctctgagggggatgataccatgatattcttggatggatgtactaacccgttactggtcaaaactgatacactagaaacacttagtaactttaatgctattgtgaacaacggagaatactacgtcatcaataaggtgtttgatttagagttatgcagcactgtttgcatactgggcccttacattgatgctaattcattgcctgatgacaaaattgtcaaagatgacaacatcactaccactatatctttacctgatttagactcaatcatgggaagaattattggtttaaatttcagacctagctcattcacattacatacatctctgtttaagtatttatgccttcggaatttgtccggtaaagtatctcacaatacattgagacaatacgccgttggttttgcacttcgaagatttgttgttcacaataaagtggtttcaaatcctagtgtgatgtatgaaatgatagatattcatgtcatgttatcacgtatttgtatgatgcaattaaaaatggaatatgatcttagtttgaactatagtgaaaaaacaaagtatttaggacctctcaggtggatgccaaaggaattggaaggtttaacgactagatacgtaataaatgctctcatagaatacataactgatagattcagcattactgaaatagacatcatgagagttttagaaagcacacacctttcagctttcataacaaaattacatgacaatcatttatggtcagctttactaaaattaagcaaaggtattactacagaaaggctcactgttagaaatttgggtgacagtcactgtgagataatatccaataacattgaaagatgcttccatcataatcaaaattgtgtgcatggtttgcttttaacagaacatatatgtaaatgttgtggtatatcgatagaatttggattattatgcgaatgttgtaaggggacgaccccaataacagcttttcaaattgatgagcaaattagaaaagaagtggatgacgagggtgaaaattataattatagatttaaagaattagaatctaaagccgacacaatcaaatctaaaataagtcatgacgagatgaaatggcctcctataaaatccaagcccagaactgttaaatatcaacagattacagcagcaagacctgtcaaacaagatgttaccgaaatgcctatcaacaaagcattaccaaccaaaacaataaatgaagttatagagaaaagaggcaaacatgttgtgtcagtaagcaatttagatgagttcaaaacgttactagatgaagatacgaagaagatccaaatcattgacgacgtcgatagtggtgctaaccaggaggaagcattaatagtacacaaagtagatgatagtaaggatacaaaaattataaaattgacggatgaacaccaagtgacttcaaagcaaccggataggcttcaaattgagatagctaaaacacctccaacagaagatgataattctactgatctatccggagaaagctggagacagatgttttctaaatttgcatcaaagatagttccaagtgtgcgtaagagaatcactaaattatcgaatgaggcacatgatttgttatctgctgataataaagaaaaagttctaaccagattgaaatatgatttttatgctcatgtaactgatcctgtggaatttgaatccagattaaatggtgagcactcaacaatgtatatcatgccgcacattccagttggattcgtagcttggcaacaagacgaatttgaagtgatagagaaaatttcattacctaattcaagctttaattcttgcggatatgaagcgttcaattatgcacttgataaacctataccttggactgattttgtttcaataactggtacagacaaaaattggtccgatttggccttaatggacttagcttcggatctaggaattaatataattatggtagaaccaagaggggtatttgttgggaaatacaaccccgaatgtgatgaattcatgtgtattcactacgatttacctttaccagacgaaaatgaaaagttaattgacacagtacaaaacagaataggtcacttttctccatgtgtaattcgcagaattagaagaggaggaacttattacgtgcatgacctaaaccaaagcatcacagacaggaataaaattatacaatcgagacttggacctcacaatcattgcaatagagcccctgatattactggagatgaaaatatattatgtgaattaatattcaatttgcatatatctgaagatttatcagacagtatatcgaaatttccgacagtatatgaaatagacgggaaaatgtacataagtaataatcctgacacaaaattattgaaatgggagaccaatctcatacatatagaaataccaaaggaatacagtactttagtggataaaatagcatcagcattggaaggttctctaaaaatatcagaattacccgaaatgagacacacaagttccgaattacccaatgagttagaaagtgaaataacagaagaaataatagaggttttgagaatcttttctagaataaattctatgttcaacgataaattagatgccaaattaatcaaggacacaaaagaatgtcgcgtgattccttggtatggtaggagcaaaataatgtttgacaaaaagttcaatcacaagttgaagaaattcgacaccttgtgcttaaaacaaggaaaacaattatataagtgtgaagtcaccaatttcagtgaaggtgatcctgttatcaatctggagctttacagtgagcaaagattcaaggtcataatgcttaaagagtcatctggtagtgcaatcaaatcattagtcagcctaatgaccgaacatattactatgtcagaattcaaagaagtgttgaaaagatctaatttgacgttggggccagcgggatatggcaaatcaactatgatatctagagctataacacacggtgatttatgtgttgctatgaccagatcatctgtaatgagcatagaagagaagacaaaggataaacacatcactgtttgctccttggaaaaagcctcatcaagtatgatgaagtgtccaaacaccatatttgtagatgaggcgactatgattgattggttgaagttagcgttattatgtgaacccacaactactttaaggatgtatggcagtgagagccaagttggagcagtagacatgagtccaacacctggtttaagacatattacaagaatacaagatttattgttagaaaatcagataagtagattttatacaacttacagaatcggtgaaagccttgccactttcataagaccaatagaacccaaactcgtatcattggctgatcacaaaacaacgtataacgtgactgtgttagaggatgcagaattcgaaaaattgccggtcattgtgcatcgatgcaaacctgatgtaattataactccatacaattataatagacagagaattgagaatatgacggatgtcacaatacctgttgtgaccacgcatagttatcaaggacaagaagttaacaaatctttagtgatactcagagcagatagaaccggcaagtgggatttgaacggaaatgctttgtatttaaattcagcgttaactagagctaagcaccattgtgagataatagtatacggttacccaatatccaacatacaaacagtaagcgatttatgtcagtatgtaggtggcgccccacatgaaaatagtttggaagaaaacacagatattgtcaaagataatccagaagatgacatggtgaacgatgacttacccactgttttaaccatacgaacaatgcatactttaagaaaacaagacattgataaattaaatgaacttagtattgttcagcaagggcattcagtaagttatttttacattcataaaaatcacataagctgcaatttgaaattcatgggtaaacgtgtggcagaaataataaacattgatggaaatgtgactgtaaatggaccttggtattataaacgcaaaatattagataaattagatgaaaaattggacttaaatgatgtaaaaggcataactatatgtccaagagggacaaaattagtgagaatcaaaaccaatcaaaaatttagaaataaggtaagggaattagcctggatagtagacaaatgctacgatggtaaattcactatcaaaataaataatatcattataactgtaacaaagaatgcaggttgtcctttatttagtggattaaagttcaggacaaagaacgaatatttcgagatttgcaaactgaaatattttagtttgagaagagaattaatcatacataaatcgaataattatagagaattgagttgtattttaaagtggttggacatagattacaattctattaactatgatgatgaagtggatattggctggctaaaaaccatgactggacataatataagctcatggagacaatacaaggaaagattatctagtgtcagtttatggtttattaacgcttgtttcgacagtacatcccgaaaatgtaaagagttaagtgatcgtaatactgccatatataatagatacatgttaacagaaaacagggagttgataaagttccatcagtctccgatccgacatgacaaattaatatacaaaaccactgaaaggagagctttaaatttatggagaactgaaaacgtttatgagttgtttaacaaagatgatttaatattaacagtaaaggaaggatctgatgaaacactctggagacaatttgtaagagaatgtttattggatatggatagaagcgatttgattaaaggaacaagcgggttggcactagacataccaggtttatatttacctctagaaaaacattatcaattagggacggagataaaacaaattattggcaccaatataaataaattactattattgactagtcctggcattcacgatagcatcagattaaatattaatgacaatgatgaattcagaacagctatactagctaggtatccaaaactcacaattcaaataggaaattataatctactaaattctggaatgataggtgtactggaacaaataatgttgaatacatacgctaagacaagcaaacacaatcctcaaatagttgtttatggtggaatgagtcctagcagtgttgccatacaaggaaaatattatgtatcattagatataccagatgaaagatccccaattaaaagattttatgatcgagaaatgccaattgttaatgcattagtccatagatttaatgaaggtagagatgatcaacataaggttagcttaaattatgacgggttattctcccgaagatatttactgggagtgagtctaaatcacgttacagaggaatatattcaacaaaaactaaataattgtgattatttatatgggtggtcctatagggttgacaatcaatccaagtggtattccattagcaacagaggagataaaatttattatcatggagaggaatactccaatcaaataagaaatcaactagctattaaaattcaaaacggtaacccattgtgggtggattacgacaaatgtgagtacgttgaaaccacaatcgtcaacgaattatttggaatgtatcttgttaaatttactaaacgaaaattcccaaatagtaacaaagttaccagagtcacattcacagaacagggctataacagtacaactgatgtagaagtgccgtggatcaacacacaaatcatggacataatgagaactagaacatttataaccactaagaaattgacaataaacaataacttattaaggaatctattattaaggttaatgacaggggatgattcagaagatagcttattagcatatgctaggacagtgcaatctacacaagtgatcactgataaaggcattcaggatttatcaacagttgatttacatgttacaatgagcactacatggtttgctttgtatgtacatcataattatttatataaatttgaacacataatttcattgattaatttgggagaagatagagaagttttattcaccttactacaacaatttattccaggcattctgaaatgggtagggatagtagcagaaaatataactgattatatggaagtatgcatgaagtatttacaatttgataggagtttccttactaatttgaagaatgttacggaaaaaattaaaaatactaactgggccatacaagaaaacaaagggaaagtttggaacttttcttttaaacacccagacgacaataatatgcctatgctggataatgacatactcccagataaagatataaataaacacaaaaactttattagagagggagattctacttgtgatcaaggatccgtcacaactcatgaagaatctgatttagaaaatactcaggaaaaattagagaatggcaaggaactaggagacaatttggaagtcttaggatttgacgatgaggttgacagggacaatcaacaattatcaagtgaaagtgttgtttataaccttggaaaagatatgaccaaagaaacagatgccacagagaagccgacctctagtgatgatcaaaaatccgtaccgactcctgatacagagattaaattaccatccgatgatgttacacaaatttcatttacagaactaactaagcctatcacaactttacccacccctatatgtgttcaaggggcatttggagaagttcctttaataatttggagttattggcaaggttctgagataagtccattcttacgcaattgtattagatcttggcaaaagtataaccctgaatttagaatagtgatactaactgacaataacttagggaacgtacatagtatatttgactccagtgatactaaacagatgtctccacaagccaaatctgactggttaagatgttattgtttatccaattacggaggagtttggttgaatttgagtagtatttgtgctgaatctctgatgccattaattaaagcagcagtgaaccatgaaagtggtttgtttcagttaggaatgccagggggagtcgacaaaatgaaatatgaaatgggtgtgatgatttgcaccactagaaataaaatattacatgaatggttcagattaacaaatgaatttgttattttatctggaggagatacaacaattatgttagatttgataaaagacagattcaaaaccaatgctcatactgccatattggcagtgggagattatggcaaattttacttatgggtttacgttttgcaaagaatagttttagatttccttaaaactgaaccctgtcatatcaatgttgaaaatcaaaaatgtctgctatatatggggaaatatgcaatagattctggtcgaacgtggcacattttatctactcgttcttggcatgatcttcaaataacagtccctgtcataaatctaataagtgcaatgcggaaaaacgttattgataattatagtaataaattcgagaaaggtagtgtgatggagatgctagatacatgtgaaccactaaaatataacccattatccttggcaaatttggcacctaaagaattaaagaaaatagattcagaagagatggaccttagacaaaagaaaaacaaaattgattatattttaatatcatatggaagttttggtgattttgtacccatattaaatatatataaatatttgattggacgaggatcaagttgtgtattggtcacccacaaggaatttgcaagttttgtaaataaagatgacttttttgacttgagaatagacacaaaggaaacatttaaattggcaatgaacttttctgaaaaaggatggtctagttgcctgtctggtagtttaaatcaattaaaagaaatggtaagttctatgaatgaattggtcaatatgtataaaaattttaactgcactatcgtgaccacacattcattttatctatataaaaattacagccagatatttggtaaagaatggatagtattggaaacgtttcctttagaaatgatgtcaccacttaataaaacaagtggttggatacaacaatttattggaaagttctataatctggacatgccattaccaattttaataggtcaaggtattgtgagaaaacaaagaccaattatatcaatgactaattgtctaccttggatggtttctaattataagattaaaaatcctgtcggaccgctgaatatgttaagtggtttccagcaacctttagggattaaaataccaaataacagtgtgttcataaatttcggtagttgcacaaaccaaaatgatgtcgagtacatgtatgaattagcaaaggacatctgctctttaggttatgataccatattatatgataagttgcacgaatcacgagtatcaaacagaattctccaaatagttgaagaatgttcaggtaaaataatattactaaaacatttcaattgctcggaaatgtatggtaaagtgttcttaacagtttgtcatggtgggcacggtacagtgttagatagtctattcaatgaaatgtttacggttgtgcaacccaaaatatttgaccaatttcattgggctacaatactagaacaatttggaattggttgttcactaaatagaaattacactaaagaagacttgacatctgttatggctttagccaaagcaagcagtcacaagttaaaggatgcaaaagctagcatgaacataaataattcggggttaatcaaacatttgaacccacgtaaagatttacacggtagaatatacccaaacgctttacgacaagcaggattgatacaaaatatagaattcattgaaggcagattcagcaccaatctacctcttggttattatgtaatagatgatatagtggatgttgaattaatgaatcctcccactcaaagccattgtgtaagagagtgcattaaacatgccttcaatagtctcactatggatgcaataatgtcatgttccagtctcagtatatccaatctttttaaaccaggggtaacagaatcagaactagaagatggtttattatctttaggggtaaattattgtttggtcaaaagaaaacaaggtcgtgtgatgaactctaagccaggaccgattttgagcttaaaaataggagacggtggcatttcgcaacattgtgtattgatcaaaatatcaagttatggcaagacagtttctttaagtggaagccctgctgtaatgcctatcaaagataaagaattgcaaaatcatatatcaaacagattaactaacaatactagtatggaactatgcaatcctcatgtgatgatgtctttattgccaaataaatgggttaaaaatttcacatcccgaactagatccataagtttgcatagtttgagtgccaggcaacaactgcacgtcacaattgcatctatgtgtagatctgggatcgcatacataggagatactcaccataatgataaagcattaggtattggttattgcagctgcaaagatggttggcaacttgtgaattttgaaatattcatgaataaattaattgtgtacacggacattccatgtgaaaatccagtcgtaattatcaatttacatctggaatacccaaaaaatatatctcgtagaactataattgatgacaaagaacgctgggtcagtctaaacaaaccaactgtaaacttcaatgaaataaacaaaccattaattagatctaatgaaatcgtctccccacatttaagtaagtttaatctaatagtggctgactttgataatcgaactcatcacaatagtgatgatattgggtatctaaagagagcaaacaaactggtcatttacagcacgccggaaatcacattcaacgatatcttagcttcacacaataaaccttacaatagattgataattaaaatgggtaatacaaaatattgtcatgaattcaattggggtaatagtgctagattgttcttgtcactaactaatggtatcttagaaggaaatagtgttgtcaccgatgttagattgtcaaatgatgtaatgaactatatatctaaatattacaaaatagtgggtttgaaagtacacactagagtctctatttatgaggatcgccctgtcataatatcagtttcagatttactagatgagttcagtcgaaacgaagaaatagaacccgatttagtaacccaattgactactctattaaaagaagaagacactgtgaaattgtcttggctgacaaaaacaaattgcaaactaaatgacagtaaagatgtcatttgcttatcagatgatacattaagtataccttgttgtgagatgataataacaaagagtgttaaaggaggtgcaaattcagatgacagaattggatggaaattagaagataaaaatcaatctttcaaaagtgacgataagtggaatgtcaaaccatctcttgaaaagaaaaacattcaatccagttgcaaagacgtcatagcattaaatgatatgaaaataaatgacgttcaagattctccgtcaattaaaaatgtaaaatactacgcaaactatgaaccaagtttggatatttacattgcaccttacactatgaattatactgctagtgtgatagagccattgtttgatatgcctgatatagcatctatgcaattatggactgatacagatttgactgattggctcaatatgtatgctccatccaataaaactgtaatcaagagtcgtgaactacccggtaaaattatcaacatggaaaaaatcacaatgacaaaatatccaattaagtctagacctgtcttaacaaaaatatgttttgaggaaggacgttccattaccggtagattgttttccgtagttaaccttcgaacagttacacctgatcctgagaaaatactttgggatgtgtgcaatgcatactttaaacccggatgggagcacaatataccgcattttaaaaatgatttattaatcataactcccgaagatgtcaaaaattggatcgaagaaaataaagattgttttggtgttgaaaaagagttaaatgatttactagcaggcgaattattaatcaaaccattaaatgatgttaatgttcatttaaagttggagtctttactaaaggacaaacatatctccattatgaaggaacagcaagctagaataatagtatggcaaaggaaagcagtttgtagtttatttgccaaattgtttgtaagatgcaaagacagactgaaaactttactgatagatcatatactttacgtggatggattgagaccagatgaaatatcagccaaattaagacaaatatctgatgtatttggattctttgaaaacgacctgactaagcaagatagacaaactgacaaaccaattttggaagtggaaatgttgatgtatcttatgttgggagttcaccctaacatcatatccagttggcgttcaagtcatgatgattggagattcaaatctacaaattattggggtaagagcacagcaatgagattaacgggacaagccacaactgcactaggaaattgtattactaatatgcaagtacactcaaaatttgtaatcaaaaataaatattggttaaagtttgctttatttcttggggacgatatgtgtatgggtttttcacacaagccaaatacacaacacttacgccaggatatagcttgtaaatttaatatgcaaagtaaagattcttggatgactaatggagcaacgttctgtagcatggtagtttacaaaacgaatgataacgtagtagaattgggcccagatgtagtcaggatgaaatttaggtatgaagttaccaatggcgtacacgaggcaacgaaagagaacttattgatgcgcaaggcatcttacttgatgatgttagggaaaacacctgaggttgataaattggtaaatgatctccaattacctatcaatcccgtacactggtacaattatcacacgatgttacagggtgttgctgacaaatgggacatgaatatacaacaggtagaagggtattatcataacttgatttacatgatatctaaagacgacatttatcaccataactttagagggttcggtaatagatgaatattataactaactctgttctgttaatttatttttaaaaggatggggcacccctcccaaaccccgagatcggaagag

SEQ ID NO: 462 - protein, 4568 aa, unidentified
  source 1..4568: note = unclassified Endornaviridae
MDDIQRPNLGTTALDPLFGWFRLPRNVHCRMNKNKFIDNFDNLFEHYKGKQFHACKEISIVCVEAMRGELQLKERHYGIAQSFSPDDERLSKFSVKNMSFGLVTRLLYLIYVKGAEIYLNPTVNVDDVLKNMSHLIKKKPEIIEEDFEEEEDFEEMDLDDMGFIDDKIEEKGEYFQIVPFGKGNCTEKFLKTLKFHMKIFKGLFNYMYHHITNFKEVNDGFVEIKGTRDEDDNSMNYESSSGKLPPIKFCPLCSCPNAYTQIPRRMKTCHYSVKRYYPNNKTIDDKFETKVNDGEIMKEIPWRCGVCYTDLNLEIEEFRQANIIIDVIITESLYVLMGDLENLMKLGYTDTYDDLKNTDKENIRQHDKILVNEYFFHLQKRIVTVGQDLDPIINDNVKKVVKGVNFRHDSKFNSVKPEFVCEMSVCREEIKSHLRSDAIACIGDLLPRTDDSKFHQWKYNDWLFEPNNFDGCCNDNCCNHNEKFTCFLGMGALALSLSQILGIVNKQRQLYAIIPRVKDNKRLRDNTGTIISEGDDTMIFLDGCTNPLLVKTDTLETLSNFNAIVNNGEYYVINKVFDLELCSTVCILGPYIDANSLPDDKIVKDDNITTTISLPDLDSIMGRIIGLNFRPSSFTLHTSLFKYLCLRNLSGKVSHNTLRQYAVGFALRRFVVHNKVVSNPSVMYEMIDIHVMLSRICMMQLKMEYDLSLNYSEKTKYLGPLRWMPKELEGLTTRYVINALIEYITDRFSITEIDIMRVLESTHLSAFITKLHDNHLWSALLKLSKGITTERLTVRNLGDSHCEIISNNIERCFHHNQNCVHGLLLTEHICKCCGISIEFGLLCECCKGTTPITAFQIDEQIRKEVDDEGENYNYRFKELESKADTIKSKISHDEMKWPPIKSKPRTVKYQQITAARPVKQDVTEMPINKALPTKTINEVIEKRGKHVVSVSNLDEFKTLLDEDTKKIQIIDDVDSGANQEEALIVHKVDDSKDTKIIKLTDEHQVTSKQPDRLQIEIAKTPPTEDDNSTDLSGESWRQMFSKFASKIVPSVRKRITKLSNEAHDLLSADNKEKVLTRLKYDFYAHVTDPVEFESRLNGEHSTMYIMPHIPVGFVAWQQDEFEVIEKISLPNSSFNSCGYEAFNYALDKPIPWTDFVSITGTDKNWSDLALMDLASDLGINIIMVEPRGVFVGKYNPECDEFMCIHYDLPLPDENEKLIDTVQNRIGHFSPCVIRRIRRGGTYYVHDLNQSITDRNKIIQSRLGPHNHCNRAPDITGDENILCELIFNLHISEDLSDSISKFPTVYEIDGKMYISNNPDTKLLKWETNLIHIEIPKEYSTLVDKIASALEGSLKISELPEMRHTSSELPNELESEITEEIIEVLRIFSRINSMFNDKLDAKLIKDTKECRVIPWYGRSKIMFDKKFNHKLKKFDTLCLKQGKQLYKCEVTNFSEGDPVINLELYSEQRFKVIMLKESSGSAIKSLVSLMTEHITMSEFKEVLKRSNLTLGPAGYGKSTMISRAITHGDLCVAMTRSSVMSIEEKTKDKHITVCSLEKASSSMMKCPNTIFVDEATMIDWLKLALLCEPTTTLRMYGSESQVGAVDMSPTPGLRHITRIQDLLLENQISRFYTTYRIGESLATFIRPIEPKLVSLADHKTTYNVTVLEDAEFEKLPVIVHRCKPDVIITPYNYNRQRIENMTDVTIPVVTTHSYQGQEVNKSLVILRADRTGKWDLNGNALYLNSALTRAKHHCEIIVYGYPISNIQTVSDLCQYVGGAPHENSLEENTDIVKDNPEDDMVNDDLPTVLTIRTMHTLRKQDIDKLNELSIVQQGHSVSYFYIHKNHISCNLKFMGKRVAEIINIDGNVTVNGPWYYKRKILDKLDEKLDLNDVKGITICPRGTKLVRIKTNQKFRNKVRELAWIVDKCYDGKFTIKINNIIITVTKNAGCPLFSGLKFRTKNEYFEICKLKYFSLRRELIIHKSNNYRELSCILKWLDIDYNSINYDDEVDIGWLKTMTGHNISSWRQYKERLSSVSLWFINACFDSTSRKCKELSDRNTAIYNRYMLTENRELIKFHQSPIRHDKLIYKTTERRALNLWRTENVYELFNKDDLILTVKEGSDETLWRQFVRECLLDMDRSDLIKGTSGLALDIPGLYLPLEKHYQLGTEIKQIIGTNINKLLLLTSPGIHDSIRLNINDNDEFRTAILARYPKLTIQIGNYNLLNSGMIGVLEQIMLNTYAKTSKHNPQIVVYGGMSPSSVAIQGKYYVSLDIPDERSPIKRFYDREMPIVNALVHRFNEGRDDQHKVSLNYDGLFSRRYLLGVSLNHVTEEYIQQKLNNCDYLYGWSYRVDNQSKWYSISNRGDKIYYHGEEYSNQIRNQLAIKIQNGNPLWVDYDKCEYVETTIVNELFGMYLVKFTKRKFPNSNKVTRVTFTEQGYNSTTDVEVPWINTQIMDIMRTRTFITTKKLTINNNLLRNLLLRLMTGDDSEDSLLAYARTVQSTQVITDKGIQDLSTVDLHVTMSTTWFALYVHHNYLYKFEHIISLINLGEDREVLFTLLQQFIPGILKWVGIVAENITDYMEVCMKYLQFDRSFLTNLKNVTEKIKNTNWAIQENKGKVWNFSFKHPDDNNMPMLDNDILPDKDINKHKNFIREGDSTCDQGSVTTHEESDLENTQEKLENGKELGDNLEVLGFDDEVDRDNQQLSSESVVYNLGKDMTKETDATEKPTSSDDQKSVPTPDTEIKLPSDDVTQISFTELTKPITTLPTPICVQGAFGEVPLIIWSYWQGSEISPFLRNCIRSWQKYNPEFRIVILTDNNLGNVHSIFDSSDTKQMSPQAKSDWLRCYCLSNYGGVWLNLSSICAESLMPLIKAAVNHESGLFQLGMPGGVDKMKYEMGVMICTTRNKILHEWFRLTNEFVILSGGDTTIMLDLIKDRFKTNAHTAILAVGDYGKFYLWVYVLQRIVLDFLKTEPCHINVENQKCLLYMGKYAIDSGRTWHILSTRSWHDLQITVPVINLISAMRKNVIDNYSNKFEKGSVMEMLDTCEPLKYNPLSLANLAPKELKKIDSEEMDLRQKKNKIDYILISYGSFGDFVPILNIYKYLIGRGSSCVLVTHKEFASFVNKDDFFDLRIDTKETFKLAMNFSEKGWSSCLSGSLNQLKEMVSSMNELVNMYKNFNCTIVTTHSFYLYKNYSQIFGKEWIVLETFPLEMMSPLNKTSGWIQQFIGKFYNLDMPLPILIGQGIVRKQRPIISMTNCLPWMVSNYKIKNPVGPLNMLSGFQQPLGIKIPNNSVFINFGSCTNQNDVEYMYELAKDICSLGYDTILYDKLHESRVSNRILQIVEECSGKIILLKHFNCSEMYGKVFLTVCHGGHGTVLDSLFNEMFTVVQPKIFDQFHWATILEQFGIGCSLNRNYTKEDLTSVMALAKASSHKLKDAKASMNINNSGLIKHLNPRKDLHGRIYPNALRQAGLIQNIEFIEGRFSTNLPLGYYVIDDIVDVELMNPPTQSHCVRECIKHAFNSLTMDAIMSCSSLSISNLFKPGVTESELEDGLLSLGVNYCLVKRKQGRVMNSKPGPILSLKIGDGGISQHCVLIKISSYGKTVSLSGSPAVMPIKDKELQNHISNRLTNNTSMELCNPHVMMSLLPNKWVKNFTSRTRSISLHSLSARQQLHVTIASMCRSGIAYIGDTHHNDKALGIGYCSCKDGWQLVNFEIFMNKLIVYTDIPCENPVVIINLHLEYPKNISRRTIIDDKERWVSLNKPTVNFNEINKPLIRSNEIVSPHLSKFNLIVADFDNRTHHNSDDIGYLKRANKLVIYSTPEITFNDILASHNKPYNRLIIKMGNTKYCHEFNWGNSARLFLSLTNGILEGNSVVTDVRLSNDVMNYISKYYKIVGLKVHTRVSIYEDRPVIISVSDLLDEFSRNEEIEPDLVTQLTTLLKEEDTVKLSWLTKTNCKLNDSKDVICLSDDTLSIPCCEMIITKSVKGGANSDDRIGWKLEDKNQSFKSDDKWNVKPSLEKKNIQSSCKDVIALNDMKINDVQDSPSIKNVKYYANYEPSLDIYIAPYTMNYTASVIEPLFDMPDIASMQLWTDTDLTDWLNMYAPSNKTVIKSRELPGKIINMEKITMTKYPIKSRPVLTKICFEEGRSITGRLFSVVNLRTVTPDPEKILWDVCNAYFKPGWEHNIPHFKNDLLIITPEDVKNWIEENKDCFGVEKELNDLLAGELLIKPLNDVNVHLKLESLLKDKHISIMKEQQARIIVWQRKAVCSLFAKLFVRCKDRLKTLLIDHILYVDGLRPDEISAKLRQISDVFGFFENDLTKQDRQTDKPILEVEMLMYLMLGVHPNIISSWRSSHDDWRFKSTNYWGKSTAMRLTGQATTALGNCITNMQVHSKFVIKNKYWLKFALFLGDDMCMGFSHKPNTQHLRQDIACKFNMQSKDSWMTNGATFCSMVVYKTNDNVVELGPDVVRMKFRYEVTNGVHEATKENLLMRKASYLMMLGKTPEVDKLVNDLQLPINPVHWYNYHTMLQGVADKWDMNIQQVEGYYHNLIYMISKDDIYHHNFR

SEQ ID NO: 463 - DNA, 13950 bp, unidentified
  source 1..13950: mol_type = other DNA; note = unclassified Endornaviridae
gtcgttcaagacatttcaaagttatgtaaattgaacgcagcaacaacagggggggggcggagacgcccccccccttttaaaaataaaaatgatcagatcaagtatgatcttggtctgatcaaatcaaaaacccccactataaaggggtttttgaaaagaatggacgatatacaacgtccaaacgtaggtactactgcattagatcctctatttggatggttcagactacctcgcaatgtccattgtaggatgaacagaaacaaattcattgacaattttgataatttatttgaacattatcaaggtaagcaatttcatacctgtaaagaaaccagcatagtgtgtgtagaagctatgaggggagaattacaattgaaagagcgacactatggtatcgctcaatctttttctccggatgatgagcgattgagcaaatttagtgtcaagaatatgtcatttggtttggtaactagattgttgtacttaatttacgttaaaggagcagaaatttacttaaaccccacagttaacgtggacaatgtgcttaaaaacatgagtcacttaattaaaaagaaacctgaattaattgaagaagaatttgaagaagaagaagacttcgaagaaatggacctagacgacatgggatttatagatgacaaaattgaagagaaaggagagtatttccaaatagtaccatttgggaaagggaattgtacagaaaagttcttaaagacattaaagtttcacatgaaaatatttaaaggattatttaattacatgtatcatcatatcaccaattttaatgaagttaacgatggattcgtagaaataaaaggaactagagatgaagatgataattctatgaattatgaatcatcatctggcaaattgcctcccattaagttctgcccattatgttcatgtcccaatgcgtacacacaaattccaaggagaatgaagacctgtcattatagtgttaaaagatattatcccaacaacaaaaccattgatgataaatttgaaactaaagttaatgatggtgaaataatgaaagagattccttggagatgtggcgtatgttatacagatttgaacttggaaattgaagagtttcggcaagccaacgtcattatagacataataatcacagagagtttatatgttttaatgggtgatctggaaaatttaatgaaattggggtacaccgacacctatgatgatttaaagaatacagataaagaaaatatcaggcaacacgataaaatattggtaaacgagtactttttccatttacaaaaacgaattgtaacagtagggcaagatttggaccctataataaatgataatgttaagaaagttgtcaaaggtgtgaatttcaggcatgacagtaagtttaatagcgttaagccagaatttgtttgtgaaatgtcagtctgtagagaagaaataaagtcacacttaagatctgatgctattgcttgcataggagatttattaccaagaactgacgacaacaaatttcatcaatggaaatataatgattggttgtttgaaccaaataactttgatggatgctgtaataataattgttgtgaccataatgaaaaattcacatgctttttgggaatgggagcattagccctgagtttatctcaaatactagggattgttaacaagcaacgtcaattatacgcgattatccctagagttaaggacaataaacgtttgagagacaatactggtacaataatctctgaagaggatgatacaatgatatttttagatggatgcactaacccgttgttagttaaaactgatacattagaaacgcttagtaactttaataccattgtaaataaaggagaatattacatcatcaataaagtttttgatttagagttatgtagcactgtttgtatattgggcccttataccgatactaactcattaccagatgacaaaattgttaaagatgacaacatcaccaccaccatatctctgcctgatttagagtcggtaatgggaagaattataggtttaaatttcaggcctagctcattcactttacatacatcattattcaaatatttatgccttcggaatttatctggaaaagtatcgcataacacattgagacaatacgctgttggatttgcacttagaagatttgttgttcacaataaagtagtgtccaaccctagtgtaatgtatgaaatgattgatatccacgttatgttatcacgtatttgcatgatgcaattaaaaatggaatatgaccttagtttgaattatagcgaaaaaaccaaatatttaggacctcttagatggatgccaaaggaattggaagggttaaccaccagatacgtgattaacgctctcgtagaatatttaactgacagatttagcatcaccgaatttgatatcatgagggttttagaaagtacacatctttccgctttcataacaaaattacacgataatcatttatggtctgctttactaaaattaagcagaggcattactactgaaagtctcaaagttagaaatttgggtgacagttattgcgagataatatccaataatatcgaaagatgttttcatcataatcaaaattgcatacatggtttacatacaactgaccatgtatgcaaatgttgtggtgtatcaatagaatttggattattatgtgaatgttgtaagggaacaaacccaataacagcattccaaattgatgaacaaatcagaaaagaggtggatgatgagagtgagaattataattatagatttaaagaattggtgtctaaagcagacacaatcaaatccaagataagtcatgacgaaatgaaatggccatctgtaaaatctaaacctagaacagtcaaatatcaacaacttcctacaactggaccagtccaacatgatgttactggaatgcctgctaataaagtattacccagcaaatcaataaatgaaattgtagaacaaagaggtaaaaaatttgcgtcaataagcaatttagaagaattcaagttattactggatgaagacacaaagaggatccaaattatagatgaagttgatagtagcatgaaccaagaagaagcgctaatagtgcatacaatagatgataacaaggacacaaaagtaataaaattgacagatgaaaagcaaacgaccacatcacagtctgacaagcatcaaacagaaattgttaaacaaccttcaacagaaggtgatgagtcactggatttgtctggagagagttggagacaaatgttttcaaattttgcatcaaaaatagttccaagtgttcgtaagagaatcactaaactatcaaacgaagcacatgatttgttatcagctgacaataaagaaaaagttctgaccaggttaaaatatgacttttattctcatgtgactgatcctgtggaatttgaatctagattaaatggtgagcaatcaacgatgtatgtcatgccgcacattccagttggatttgtagcttggcaacaagacgaattcgaagtggtggaaaaaatttcactacccaattcaagttttaattcttgtggatacgaagcatttaattacgctcttgataaacctataccttggacagactttgtatcaataactggtacagataaaaattggtcagatttggccttaatggacttagcttcagatctggggataaatataattatggtggaaccaagaggagtattcgtggggaaatacaaccccgattgtgatgaattcatgtgcatccattacgatctaccattaccagatgaaaatgaaaagttaattgacacagtgcagaatagaataggacacttttctccatgcataattcgcagaactagaagaggaggaacttattatgtacacgatttgaaccaaagcattacagacaggaacaaaattatacaatccagacttgggcctcataatcattgcaatagagcacctgacatcactggtgatgaaaatatattgtgcgagttaatattcaatctgcatatatctgaggatttatcggacagtatatctaaatttccaactgtatatgaaatagatggaaaaatgtacataagcaataatcctgacacaaaattattaaaatgggagactaatcttatacacatagaaattccaactgagtacagcactttggtggataaaatagcatctgcattagaaggttccttaaaaatatctgaattgcctgagatgagacacacaagttctgaattacccaatgaactggaaagtgaaataacagaagaaataatagaagttttgagaatcttttctagaataaattcaatgtttagtgatagattagatgctaaattaatcaaagacaccaaagattgtcgtgtgattccttggtatggaaggagcaaaataatgttcgacaaaaaatttaaccacaaacttaaaaaattcgacactttatgcttaaaacaaggaaaacaattatataagtgcgaggtaactaattttagtgaaggtgatcctgttatcaacttagaactttacagtgagcaaagatttaaggttataatacttaaagaatcatctggcagtgcaatcaaatcattggttagcttgatgactgagcatatcactatgtcagaatttaaagaagtgttaaaaaggtccagtttaacactggggccagcaggatatggtaagtcaactatgatatcaaaagctataacacacggtgatttatgtgttgctatgaccaggtcctctgtgatgagtattgaagaaaagacaaaggacaaacacgtcactgtgtgttccttagaaaaagcctcatcaagcatgatgaaatgtccaaacaccatatttgtggatgaggctactatgattgactggttgaggttagctttattatgtgaacccacaactactttaaagatgtatggaagtgaaagccaggttggagcagtagacatgagtccaacacctggtttaagacatattacaagaatacaagatttgttattagagaaccaaataagtagattttataccacctataggattggtgaaagtctagctacttttataaggccgatagaacctaagcttgtatcgctagctgaacacaaaacaacatataacgttactgtgttggaagatgcagaattcgaaaaattgccgatcatagtacatcgatgcaaacctgatgtgattattacaccatacaactataatagacagaggatcgagaatatggcggatgttacaatacctgttgtaaccacgcatagctatcaaggacaagaagtcaataaatctttagtgatactcagagcagatagaactggtaagtgggatttgaatgggaatgcattgtatttgaattcagctttaactagagccaagcaccattgcgaaataatagtatatggttacccaatctctaacattcaaacagtaagcgacttatgtcaatgtgtaggaggggttctacatgaaaattgtttggaagataacactaattttaccaaagatagtccagaagatgatatggtaaatgatgatttgccaactgttttaaccatacggacaatgcacactctaagaaagcaagatattgataagttaaacgaacttagtattgtccaacaagggcactctgtaagttatttttacctccgcaaaaatcacataagttgtaatttaaaatttatgggtaagagtgtggcagaaataataaacattgatgggaatgtgactgtaaatgggccctggtattataaacgaaaaatattagataaactagacgaaaaattagacttaaacgacataaaaggtataactatatgtccacgagggacaaaattagtaaaaatcaaaactaatcagaaatttagaaacaaggtaagggaattagcttggatagttgataaatgctatgatggtaagtttaccattaaaataaataatattattataactataacgaagaatgcaggttgccctttattcagtggattgaagtttaggacaaagaatgaatacttcgaaatttgcaaactaaagtatttcagtttgaggagagaattagttatacacaaatctaatgactacagagagttgagttgcattctaaaatggttggacatagattacaattccattaattatgatgatgaggtggatattggttggttgaaaactatgactgggcataatataagttcatggaggcaatacaaggaaagactatctagtgttggtttatggtttattaatgcatgtttcgatagcacatctcgaaaatgtaaggagttaagtgaccgcaatactgctatctataataggtacatgttaacagagaatagggagttgataaagttccaccaatctccaatccgacacgataaattaatatacaaaaccactgaaagaagagctttgaatctgtggagatcggaaaatgtttacgaactgttcaacaaagatgatttaattttaacagtaaaagaagggtctgatgaaacactttggagacaatttgttagagaatgtctactagatatggatagaagcgatttgattaaagggacaagcgggttgtcactcgagataccaggcttatatttacctctggaaaaacattatcaattgggaacagagataaaacagattattggcaccaatataaataaattattattgttaactagcccaggtattcatgatagtattagattgaacattaatgataatgacgaatttagaacagcgattctagctagatatccaaaactcactattcaaattggaaattataatttattaaattcagggatgataggtgtgttggaacaaatcatgttaaatacatatgccaagacaagcaaaaataaccctcaaatagtggtttacggtggtatgagtcctagcagcgtagctgtgcaagggaaatattatgtatcattagacataccagatgaacaatccccaattaaaagattttatgatcgagaaatgccgattgtcaatgccttagtccataggttcaatgaaggtagagatgatcagcataaggtcagcttgaattataatggatcattttcccggagatatttgttaggtgttagcctgaatcatgtgactgaggattacattcaacaaaaattaaataattgcgattatttgtacggatggtcttatagagttgacaatcaatctaagtggtattctattagcaacagaggagataaaatttattatcacggagaagaatattctaatcagataagaaaccaactagctatcaaaattcaaaacggtaatccgttgtgggttgattatgatagatgtgaatacgttgaaaccacaattgtcaatgagttatttggaatgtatcttgtcaaatttacaaaaaagaaattcccaaataccaacaaagtcactagagtcacattcacagaacagggctataacagcacaactgaggtagaagtaccatggatcaatacacaaatcatggatataatgagaactagaacatttataaccacaaaaaaattgacaataaataataatttattaaggaatttgttattaaggttgattacaggagacgattcagaggatagcctattggcatatgctagaacagtacaatctacacaagtgatcactgacaaaggcattcaagatctgtctaccgtcgatttacatgttacgatgagcactacatggtttgctttgtatgtacaccacaattatctgtacaaatttgaacacataatttcgttgatcaatttgggtgaagacaaagaagttttatttactttactacaacaattcattccaggcattctgaaatgggtagggatagtggcagaaaatataacagattatatggaagtgtgtatgaaatatttgcaatttgatagaagtttcctcactaatttaaaagatgtcactgagaaaattaaaaatactaactgggctatacaagaaaacaaagggaaagtctggaacttttcttttaaaaaccctgatgacaataacatgcctatgctcgataatgacataattccagacaaagaaaatgacggatacgatcgttcaaaaaaagatgaaggttccacatctgattgtgaatccgtatccactcaagaagattctgagtcagagatcacccaaaccaaatcgaacaatggcgaggagcaaggagaaaattgtaatgcaacaggttttaacgatgaggttaatgaggatattcaaccatcatcaaaagaaagtgctgttgataaccttgatgagagcacaaccgaaaaaccagacgtcaaagagaagccaacttctggtgatgagcggaagtccataccaacttctgacacaaaaattaaaacaccatctgatgatgatacacaaatttcatttacagaattaacaaaacccatttcaaccctgcccgctcctttatgtgtgcgaggaacatctggggaaatccctttgataatttggagttattggcaaggttccgaaataaatccatttttacgtaattgtattagatcatggcaaaaacacaatccagaggttagaatagtgatattgacagataataatttagggaacatacatagcatatttgattcaagtaacaccaaacaaatgtctccacaagctaaatccgattggttaagatgttattgtttatctaattacggaggaatttggctcaacttgagcagcatttgtgctgattccttaatgccattaattaaagcggcagccaatcatgaaagtggtttatttcaattaggaatgccaggaggaatagataaaatgaaatatgaaatgggtataatgatttgcaccacaaaaaataaaatactacatgaatggtttagattgacaaatgagttcgtcattctttctgggggagacactacaataatgttagatttgattaaagacagattcaaaaccaatgctcatgctgcaatattggcagtaggggattatggtaaattttacttatgggtttacgttttacaaagaatagtcttagatttcattaaaatggaaccctgtcatatcaatactgaaaatcaaaaatgcttgctatatatggggaaatatatgatagaccctaaccaaacatgggacattctatcaacccggtcttggcaagatcttcaaatgactgttcctgtcataaatctaataagtgtaatgcggaaaaatgttatagataattataatgataaattcgagagaagtagtgtgatcgggatgttagataaatgtgagccactaaaatataacccattgtcattggcaaatttaacacctaaagaaataaagagaatagactcagaagagactgtctttagacaaaagaaaaccaaaattgattatattttaatatcatacggaagttttggtgattttgtaccaatattgaatatatataaatatttgattggacgaggatcaagttgtgttttggttactcacaaagaatttgcaagtttcatagataaaaatgatttcttcgacttaaaaatagataccaaggaaacattcaaattggccatgaacttctctgaaaagggatggtctagttgtttgtctggtagtttaaaccaattaaaagaaatggtaagctctatgaatgatttagtcaatctgtataagagttgcgattgcactattgtgacaacacattcattctatttatacaaaaattacagtcaaatatttggtaaagaatggatagtattggaaacatttcctctggaaatgatgtcaccacctaataaatcaagtggttggatacagcaatttattggaaagttttataatctggacataccactaccaattttaactggccaaggtattgtaagaaaacaaagaccaattatatctatgactaattgtttgccttggatggtttccaattataagattaaaaatccagttggaccattaaatatgttaagtggtttccagcaacctttaggcattaaagtgccaaacaacagtgtgttcataaattttggcagttgtacgaatcaaaacgatgttgaatacatgtatgaattggcaaaagacatttgcgctttaggttacgatacaatattatatgataagttgcatgattcaagggtgtcaagcaagatccttaaaatagtggaagaatgttctgggaaaataatgctactaaaacaatttaattgctctgaaatgtatggtaaagtgtttttgacaatctgtcatggtggtcacggcaccatattggatagcttattcaatgaaatgtttactgttgtacaacctaaaatttttgatcaatttcattgggctacagtactggaacaatttggaattggttgttcactaaaaagaaattatactaaagaagatttgacatctattatgactttagcaaaggctaacaaccataggttgagggatgcaaaagctaatatgagcataaataatttaggattaattaaacagctgaacccgcgaaaagatttgcatgggaggatatttcccaacgctctgcgacaagcagggctactacaaaatatagaatttatagaaggtagatttagcactgatctacccctcggttattatataatagacgatatagtggatgtcgaattaatgaatcctcccactcaaagtcattgtgtgagagagtgcattaaatacgcctttaatagtctcactatggatgcaataatgtcatgctccagtctcagcatatctaatctgttcaaaccaggggtgacggaatcagaattagaagatggtctgttgtctttaggagtaaattactgtttagtcaaaagaaagcagggtcgtgtaatgaattctaaaccaggaccaatattatgtttaaaaataggagacggcggtatttcacagcattgtacactgatcaagattacaagtcatggtaagacagtgtcattaagtggaagcccaatggtgatgtctatcaaagataacgaattgcgaaatcacatatcagacagattgacaaacaacactagtttggaattatgcaatccccatgtaatgatgagtttattaccaaacaaatgggttaaaaactttgtatctcgtacgagatccattagtttgcatagtttaagtaccaggcaacaattgcatgttacaataacatctatgtgtaaatccggaattgcatatataggtgacactcaccacagtgataaagcattaggtgttggttattgcagttgtaaggaaggttggcaacttgtaaatttcgaaatatttatgaataaattaattgtgtacacggacattccatgtgaaaatccggttgtaatcatcaatttacacctagaatacccaaaaaatatatctcgtagaactataattgatgacaaagaacgttgggttagtctaaacaaaccaactgtaaactttaatgaaataaacaaaccattaatcagatctaacgaaatcgtgtcccctcacttaaataagtttaatttaatagtagctgactttgataatcgaactcatcacaacagtgatgatattggatatttgaagagagcaaacaagttggtcatttacagtacaccggaaattacattcaatgatatcttagcttcacacaataaaccttataatagattgataattaagatgggtaacaccaaatattgtcacgaatttaattggggcaatagtgctaggttgttcttatctctaaccaatggcatcctagaaggaaatagtgttattactgatactagattgtcaaatgacataataagctatatatctagatattataaaatagtgggtttgaaagtgcacactagagcttctatttatgaagatcgtcctgttataataacagtttcagatttgttagacgagttcagtagaaacgaagaaattgatcccgatttagtgacccaattaacgactttattaaaagatgaagacacagtgaaattatcctggctaacaagaacaaattgcaaattaaatgatgggaacgacgttatttgcttgtcagatgatacattaagtattccttgttgtgaaatgacaataacaaaaagtgttaaaggaggagtgaatccagaggatagaatcggatggaaactggaagataaaaatcaatcctttaagagtgatgacaagtggaatgttaaaccatctcttgaaaagcggaccattcaatctagctgcaaagatgtcatagctctaaacgacatgaaaataaatgatgtccaagattctccatcaattaaaaattttaattattattcaaattatgaaccaagtttagatatctacattgccccttacactatgaactatactgccagtgtgatagagccattatttgatatgccagacatagcaacaatgcaattatggacagatactgatttaacagattggctcaatatgtatgccccatccaacaaaactgtaatcaagagtcgtgaactacctggtaaaattatcaacatggaaaaaataactatgacaaaatatccaattaaatctagaccagttttaactaaaatatgctttgaagaaggacgttctattaccggtagactgttttcagttgtcaaccttcgtacagttacgcctgaccctgagagaatactttgggatgtgtgcaatgcatatttcaaacctggttgggagctaaatataccgcattttaaaaatgatttattgattataactcctaaagatgtcaaagattggatcgaagagaataaagattgctttggtgttgaaaaagagctaaatgatttgctagcaggtgaattattgattaaaccgttaaatgatgtaaatgttcatctgaaattagagtccttactaaaagacaaacatatctccatgatgaaggaacaacaagctaggataatagtatggcaaagaaaagctgtttgtagtttatttgccaaattgtttgtgaaatgtaaagatagactaaaatctttacttatggatcatatactttacgtcgatggactgagaccagacgaaatctccgctaaattaaggcagatatctgatgtattcggattctttgaaaacgacttgacaaagcaagatagacaaactgataagcccattttagaagtggaaatgttgatgtatctaatgctaggagttcatcccaacgttatatccagttggcgttcaagtcatgatgattggagatttaaatccacaaactattggggtaaaagtactgcaatgagattaactggacaagctacaactgccctaggaaattgtatcacaaacatgcaagtgcactcaaaatttgtaatcaaaaataaatattggttaaaatttgctttgttccttggagatgatatgtgtatgggcttctcacacaaaccaaatacacaacacttacgtcaggatatagcttgtaaatttaacatgcagagcaaagattcttggatgaccaatggggcaacgttttgtagtatggtggtttacaaaacaaatgataatgtagtggaattaggtccagatgtggtcaggatgaaatttagatatgaagttaccaatggtgtacacgaagcaaccaaagagaacttattaatgcgcaaggcttcctacttaatgatgttgggaaaaacccctgaagttgataaattagtaaaggatctcaagttacctatcaatcctgttcattggtacaattatcacacaatgttacaaggcgttgctgataaatgggatatgaacatacaacaagttgaagggtattatcataatttgatttacatgatatccaaagatgatatttatcaacataactttagaggatttggcaacagatgaagttcatgaatagctgatttcaattaatttatttttaaaagggtggggtccccctcctcaaccccggcc

SEQ ID NO: 464 - protein, 4568 aa, unidentified
  source 1..4568: note = unclassified Endornaviridae
MDDIQRPNVGTTALDPLFGWFRLPRNVHCRMNRNKFIDNFDNLFEHYQGKQFHTCKETSIVCVEAMRGELQLKERHYGIAQSFSPDDERLSKFSVKNMSFGLVTRLLYLIYVKGAEIYLNPTVNVDNVLKNMSHLIKKKPELIEEEFEEEEDFEEMDLDDMGFIDDKIEEKGEYFQIVPFGKGNCTEKFLKTLKFHMKIFKGLFNYMYHHITNFNEVNDGFVEIKGTRDEDDNSMNYESSSGKLPPIKFCPLCSCPNAYTQIPRRMKTCHYSVKRYYPNNKTIDDKFETKVNDGEIMKEIPWRCGVCYTDLNLEIEEFRQANVIIDIIITESLYVLMGDLENLMKLGYTDTYDDLKNTDKENIRQHDKILVNEYFFHLQKRIVTVGQDLDPIINDNVKKVVKGVNFRHDSKFNSVKPEFVCEMSVCREEIKSHLRSDAIACIGDLLPRTDDNKFHQWKYNDWLFEPNNFDGCCNNNCCDHNEKFTCFLGMGALALSLSQILGIVNKQRQLYAIIPRVKDNKRLRDNTGTIISEEDDTMIFLDGCTNPLLVKTDTLETLSNFNTIVNKGEYYIINKVFDLELCSTVCILGPYTDTNSLPDDKIVKDDNITTTISLPDLESVMGRIIGLNFRPSSFTLHTSLFKYLCLRNLSGKVSHNTLRQYAVGFALRRFVVHNKVVSNPSVMYEMIDIHVMLSRICMMQLKMEYDLSLNYSEKTKYLGPLRWMPKELEGLTTRYVINALVEYLTDRFSITEFDIMRVLESTHLSAFITKLHDNHLWSALLKLSRGITTESLKVRNLGDSYCEIISNNIERCFHHNQNCIHGLHTTDHVCKCCGVSIEFGLLCECCKGTNPITAFQIDEQIRKEVDDESENYNYRFKELVSKADTIKSKISHDEMKWPSVKSKPRTVKYQQLPTTGPVQHDVTGMPANKVLPSKSINEIVEQRGKKFASISNLEEFKLLLDEDTKRIQIIDEVDSSMNQEEALIVHTIDDNKDTKVIKLTDEKQTTTSQSDKHQTEIVKQPSTEGDESLDLSGESWRQMFSNFASKIVPSVRKRITKLSNEAHDLLSADNKEKVLTRLKYDFYSHVTDPVEFESRLNGEQSTMYVMPHIPVGFVAWQQDEFEVVEKISLPNSSFNSCGYEAFNYALDKPIPWTDFVSITGTDKNWSDLALMDLASDLGINIIMVEPRGVFVGKYNPDCDEFMCIHYDLPLPDENEKLIDTVQNRIGHFSPCIIRRTRRGGTYYVHDLNQSITDRNKIIQSRLGPHNHCNRAPDITGDENILCELIFNLHISEDLSDSISKFPTVYEIDGKMYISNNPDTKLLKWETNLIHIEIPTEYSTLVDKIASALEGSLKISELPEMRHTSSELPNELESEITEEIIEVLRIFSRINSMFSDRLDAKLIKDTKDCRVIPWYGRSKIMFDKKFNHKLKKFDTLCLKQGKQLYKCEVTNFSEGDPVINLELYSEQRFKVIILKESSGSAIKSLVSLMTEHITMSEFKEVLKRSSLTLGPAGYGKSTMISKAITHGDLCVAMTRSSVMSIEEKTKDKHVTVCSLEKASSSMMKCPNTIFVDEATMIDWLRLALLCEPTTTLKMYGSESQVGAVDMSPTPGLRHITRIQDLLLENQISRFYTTYRIGESLATFIRPIEPKLVSLAEHKTTYNVTVLEDAEFEKLPIIVHRCKPDVIITPYNYNRQRIENMADVTIPVVTTHSYQGQEVNKSLVILRADRTGKWDLNGNALYLNSALTRAKHHCEIIVYGYPISNIQTVSDLCQCVGGVLHENCLEDNTNFTKDSPEDDMVNDDLPTVLTIRTMHTLRKQDIDKLNELSIVQQGHSVSYFYLRKNHISCNLKFMGKSVAEIINIDGNVTVNGPWYYKRKILDKLDEKLDLNDIKGITICPRGTKLVKIKTNQKFRNKVRELAWIVDKCYDGKFTIKINNIIITITKNAGCPLFSGLKFRTKNEYFEICKLKYFSLRRELVIHKSNDYRELSCILKWLDIDYNSINYDDEVDIGWLKTMTGHNISSWRQYKERLSSVGLWFINACFDSTSRKCKELSDRNTAIYNRYMLTENRELIKFHQSPIRHDKLIYKTTERRALNLWRSENVYELFNKDDLILTVKEGSDETLWRQFVRECLLDMDRSDLIKGTSGLSLEIPGLYLPLEKHYQLGTEIKQIIGTNINKLLLLTSPGIHDSIRLNINDNDEFRTAILARYPKLTIQIGNYNLLNSGMIGVLEQIMLNTYAKTSKNNPQIVVYGGMSPSSVAVQGKYYVSLDIPDEQSPIKRFYDREMPIVNALVHRFNEGRDDQHKVSLNYNGSFSRRYLLGVSLNHVTEDYIQQKLNNCDYLYGWSYRVDNQSKWYSISNRGDKIYYHGEEYSNQIRNQLAIKIQNGNPLWVDYDRCEYVETTIVNELFGMYLVKFTKKKFPNTNKVTRVTFTEQGYNSTTEVEVPWINTQIMDIMRTRTFITTKKLTINNNLLRNLLLRLITGDDSEDSLLAYARTVQSTQVITDKGIQDLSTVDLHVTMSTTWFALYVHHNYLYKFEHIISLINLGEDKEVLFTLLQQFIPGILKWVGIVAENITDYMEVCMKYLQFDRSFLTNLKDVTEKIKNTNWAIQENKGKVWNFSFKNPDDNNMPMLDNDIIPDKENDGYDRSKKDEGSTSDCESVSTQEDSESEITQTKSNNGEEQGENCNATGFNDEVNEDIQPSSKESAVDNLDESTTEKPDVKEKPTSGDERKSIPTSDTKIKTPSDDDTQISFTELTKPISTLPAPLCVRGTSGEIPLIIWSYWQGSEINPFLRNCIRSWQKHNPEVRIVILTDNNLGNIHSIFDSSNTKQMSPQAKSDWLRCYCLSNYGGIWLNLSSICADSLMPLIKAAANHESGLFQLGMPGGIDKMKYEMGIMICTTKNKILHEWFRLTNEFVILSGGDTTIMLDLIKDRFKTNAHAAILAVGDYGKFYLWVYVLQRIVLDFIKMEPCHINTENQKCLLYMGKYMIDPNQTWDILSTRSWQDLQMTVPVINLISVMRKNVIDNYNDKFERSSVIGMLDKCEPLKYNPLSLANLTPKEIKRIDSEETVFRQKKTKIDYILISYGSFGDFVPILNIYKYLIGRGSSCVLVTHKEFASFIDKNDFFDLKIDTKETFKLAMNFSEKGWSSCLSGSLNQLKEMVSSMNDLVNLYKSCDCTIVTTHSFYLYKNYSQIFGKEWIVLETFPLEMMSPPNKSSGWIQQFIGKFYNLDIPLPILTGQGIVRKQRPIISMTNCLPWMVSNYKIKNPVGPLNMLSGFQQPLGIKVPNNSVFINFGSCTNQNDVEYMYELAKDICALGYDTILYDKLHDSRVSSKILKIVEECSGKIMLLKQFNCSEMYGKVFLTICHGGHGTILDSLFNEMFTVVQPKIFDQFHWATVLEQFGIGCSLKRNYTKEDLTSIMTLAKANNHRLRDAKANMSINNLGLIKQLNPRKDLHGRIFPNALRQAGLLQNIEFIEGRFSTDLPLGYYIIDDIVDVELMNPPTQSHCVRECIKYAFNSLTMDAIMSCSSLSISNLFKPGVTESELEDGLLSLGVNYCLVKRKQGRVMNSKPGPILCLKIGDGGISQHCTLIKITSHGKTVSLSGSPMVMSIKDNELRNHISDRLTNNTSLELCNPHVMMSLLPNKWVKNFVSRTRSISLHSLSTRQQLHVTITSMCKSGIAYIGDTHHSDKALGVGYCSCKEGWQLVNFEIFMNKLIVYTDIPCENPVVIINLHLEYPKNISRRTIIDDKERWVSLNKPTVNFNEINKPLIRSNEIVSPHLNKFNLIVADFDNRTHHNSDDIGYLKRANKLVIYSTPEITFNDILASHNKPYNRLIIKMGNTKYCHEFNWGNSARLFLSLTNGILEGNSVITDTRLSNDIISYISRYYKIVGLKVHTRASIYEDRPVIITVSDLLDEFSRNEEIDPDLVTQLTTLLKDEDTVKLSWLTRTNCKLNDGNDVICLSDDTLSIPCCEMTITKSVKGGVNPEDRIGWKLEDKNQSFKSDDKWNVKPSLEKRTIQSSCKDVIALNDMKINDVQDSPSIKNFNYYSNYEPSLDIYIAPYTMNYTASVIEPLFDMPDIATMQLWTDTDLTDWLNMYAPSNKTVIKSRELPGKIINMEKITMTKYPIKSRPVLTKICFEEGRSITGRLFSVVNLRTVTPDPERILWDVCNAYFKPGWELNIPHFKNDLLIITPKDVKDWIEENKDCFGVEKELNDLLAGELLIKPLNDVNVHLKLESLLKDKHISMMKEQQARIIVWQRKAVCSLFAKLFVKCKDRLKSLLMDHILYVDGLRPDEISAKLRQISDVFGFFENDLTKQDRQTDKPILEVEMLMYLMLGVHPNVISSWRSSHDDWRFKSTNYWGKSTAMRLTGQATTALGNCITNMQVHSKFVIKNKYWLKFALFLGDDMCMGFSHKPNTQHLRQDIACKFNMQSKDSWMTNGATFCSMVVYKTNDNVVELGPDVVRMKFRYEVTNGVHEATKENLLMRKASYLMMLGKTPEVDKLVKDLKLPINPVHWYNYHTMLQGVADKWDMNIQQVEGYYHNLIYMISKDDIYQHNFR

SEQ ID NO: 465 - DNA, 412 bp, unidentified
  source 1..412: mol_type = other DNA; note = unclassified Endornaviridae
tttttttttttttttttttttttttttttttttttttttttcattgtacttcgttcagttgcccctcaattctgagtgtttatggatgcatcgccctaccgtgacaagaaagttgtcggtgtctttgtgtttctgttggtgctgatattgctgggggtaaaacaaacaaggttttatgactactaagttgtctagaccttttgctttacgtttactgggtggcaagggaggagggccccccccccctgtgtgtgtgtgtgtgtgtgtgtgtgtgtgtgtgtgtgtgtgtgtgtgtgtgtgtgtaaaaaaaaaaaaaaaaaaaaaaaaaaaaaaaaaaaaaagaaaaaaaagaaaaaaaagaagatagagcgacaggcaagtcaccaaagacaccaatgcttttcatcgcccg

SEQ ID NO: 466 - DNA, 67 bp, unidentified
  source 1..67: mol_type = other DNA; note = unclassified Endornaviridae
gtaaaacaaacaaggttttatgactactaagttgtctagaccttttgctttacgtttactgggtggc

SEQ ID NO: 467 - DNA, 628 bp, unidentified
  source 1..628: mol_type = other DNA; note = unclassified Endornaviridae
attgtacttcgttcagttgctgaattggtgtttatggtcataaataccgtgacaagaaagttgtcggtgtctttgtgacttgcctgtcgctctgtcttctttttttttttttttattttttttttttttttttttttttttttttttttttttttttttttttttttttttttttttttttttggaggtctaccgagaaccgaacccaggtcgctggattcaaagtccagagtgctaaccactacaccatagaacccccagcaatatcagcaccaacagagcttacaagaacaccgacaactttccttgtccctattgtacttcgttcagttgctgaattggtgtttatggtcataaataccgtgacaagaaagttgtcggtgtctttgtgacttgcctgtcgctctgtcttctttttttttttttttattttttttttttttttttttttttttttttttttttttttttttttttttttttttttttttttttttggaggtctaccgagaaccgaacccaggtcgctggattcaaagtccagagtgctaaccactacaccatagaacccccagcaatatcagcaccaacagagcttacaagaacaccgacaactttccttgtccct

SEQ ID NO: 468 - DNA, 373 bp, unidentified
  source 1..373: mol_type = other DNA; note = unclassified Endornaviridae
acgaagtgataagaaaaaacccgggagcacgcccaggggtcctcgttgacttagcacagcaagacaaacaaactgaccatgaaataatcaaatttgaaatggcactgtacaaactgttaggggtgcatgatgacgttataaccttgtggcacaacagtcatttcaattggaaatacaaatccaggacagtaagaggagagggagatgccatgagattgactggtcaagcaaccacagctctgggaaatgctataaccaatatgttggtgcacagacgattagttaaccggctcggacataatttaagattgtttttaattttaggagatgatggtctcatgtttaccaatacgagcatagatctcagtcgaaa

SEQ ID NO: 469 - DNA, 373 bp, unidentified; identical to SEQ ID NO: 468
  source 1..373: mol_type = other DNA; note = unclassified Endornaviridae

SEQ ID NO: 470 - DNA, 3370 bp, synthetic construct
  source 1..3370: mol_type = other DNA
cttatcgaaattaatacgactcactataggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaaaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggcgttagtagtcaaggatgacgttaagatttctgagttcatcaatttgtctaccgctgagaaattcttacctgctgttatgacttcggtcaagacggtacgaatttcgaaagttgacaaagtgattgcaatggaaaacgattcgttatccgatgtagatttgcttaaaggtgttaagcttgttaaagatggttatgtgtgtttggcagggttagttgtgtccggggagtggaacctaccggacaactgcagaggtggagtaagcgtttgtttggttgacaagagaatgcaaagagatgacgaagcaacacttggatcttatagaaccagtgcggctaagaaacgatttgccttcaaattgatcccgaattatagcattactaccgccgatgctgagagaaatgtttggcaagttttagttaatattagaggtgttgccatggaaaagggtttctgtcctttatctttggagtttgtctcagtttgtattgtacacaaatccaatataaaattaggcttgagagagaaaattactagtgtgtcggaaggaggacccgttgaacttacagaagcagttgttgatgagttcatcgaatcagttccaatggctgacagattacgtaaatttcgcaatcaatccaagaaaagaagtaataagtatgtaggtaagagaaatgataataagggtgtgaataaggaaaggaagctgtttgataaggttagaattgggcagaactcggagtcatcggacgccgagtcttcttcgttttaaagactctataaatataagagagcctcttatagtaagcagagttgttggagacgttcttgatccgtttaatagatcaatcactctaaaggttacttatggccaaaagagtttgagagagaagattacaaacgtgagagacggagggcccatggaacttacagaagaagtcgttgatgagttcatggaagatgtccctatgtcgatcaggcttgcaaagtttcgatctcgaaccggcgtatgttaagagaaaggcagtactttaagcacgaagtgcttcactggtttgaaggaatttaaagccaggttaacaacaaaatttgagttttcggggagggagggccccccccccccgcacctcgagtttctccataataatg

SEQ ID NO: 471 - DNA, 3280 bp, synthetic construct
  source 1..3280: mol_type = other DNA
cttatcgaaattaatacgactcactataggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaaaaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggccccccccccccgcacgcacctcgagtttctccataataatg

SEQ ID NO: 472 - DNA, 1689 bp, synthetic construct
  source 1..1689: mol_type = other DNA
cttatcgaaattaatacgactcactataggccaccaatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgctggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaa

SEQ ID NO: 473 - RNA, 3242 nt, synthetic construct
  source 1..3242: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtggctacccgaaattcaatactcctctttatcttcaaatgctcccgcttctaaaagacaatcctatctttcggaagccatttgtatttgggacagaagccagtagaactctaggatcggatgccatttgctgcacgccaaaaatacatcgagcagatcttcgccttcgagtaaagctaccacttctatctattatctactataccccagagtcaaatatcatcgtgacgaaaactgtggcgagcctgagaaagattgtgcaaagtctcaacattttcgaagacccctacgttttgacactaaaaaggagtgatagcgaaaaaagtcaacgtgagctggcgaaagtactcaagagtactagaagatgcgccatatggcagaccaaatactacttcacccggtcctggaatgcacaatctagagatacctatgggtcctggggcacatagaattggaacgccgagtgatcaattgcaagctcaaccatcttattcggtcgaacatttagatcaaaatcaataccatcagcgcatgcccctcaatcccagtaaaactacgaaggttgatggtaaagcagcagtcattgaagaaatcgacagaccgcaagaggatattgatagtcagtttgaggcaactgtcaagcgtgctcttagtccatttgttcctgaagttgaagatgagagtaagaccttggaagattcttacaaatctttcagaaccaagcttttgatctcttgggtattctcaaacgcgttgttggctgttgctatcactagtgacagtgttgatggatttggtttcggaaatactgcatcaataagaactgctaaacctgcaatcaaagagtattaccatggtgatctagtggtcaagaatagtgcgatcaagagtgaaggccaaaatgaaaatcattattgggttatatcacgagtgatggatgacaattacaaaacagccaacgcatcttatcaagtggatatcctcagaagcagattgttattttggccatctcaccatcatcgcagatggatatgcctccaaattccgcaagcaatacatcaacaaaactcccattgtcaaaagtaaattctacgctctagaattaatagattgtcccatgccagctcccaatcatggaatcgtagtcctctcggacgtctccccagttctcctctatcaaatcggtacccacgagcgaagttgatggagcaaaagaagttcatgaaaattggcttgtctacagaagctttccgatcctacgtcccaatcatacaaatggaggtggaaaactttatgaagcgttcttcggcgttcaaaggtccaaagggaactgctgacattggtcccgctatggctgaaatcaccatctacactgcttcgcacactctgcaaggaaaggaagtccgcgatcgattcgatacctcctttgcctctctctaccacgacctttcaacgctgtcaactgggtagaatcatctgcatgggatggaagagacgccattgtcgttgctggagatattgctctatatgccaagggtgctgcacgtccaactggaggtgctggagctgttgccatgttgattggaccaaatgctccagttgttgtcgagcctggtcttcgcggatcctacatgcaacatgcctacgatttctacaagtctggctaagcctagtcaattgaatgcgttcattcgttatagttcacagcagactgaaagtcatgatacgttaacagagacaactcgaaatattggcatcatagctcatatcgatgcaggcaaaactacaactactgagcgtatgctctattacagtggctatactcgacgcataggagacgttgtctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagaaggcaggatgaccacggattaggcgcgtatgttaagagaaaggcagtactttaagcacgaagtgcttcactggtttgaaggaatttaaagccaggttaacaacaaaatttgagttttcggggagggaggg

SEQ ID NO: 474 - RNA, 4004 nt, synthetic construct
  source 1..4004: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtggatccgagatggcactgcaggatgtgaagaatcctacatattcaacccagataataaacgctctgtcgaccccatgtacaatatggagttaagcagagctaagtctagaatgggcatgtctgctggttcatcttcttatgaagagtcttacagtgcacagggcaacgccgtcaagaagctcaaggactctcaattcgagtaatcagcctacccgtagtacacttcaatggttcattgcacgcggcctcgccgcattctgtatagctagtgatataatagatgtaagactgttgttggcgtgtgtggagcgtatgtgcgagcgattgtgaaaaccatggtcggtatgggacaaaaggactcatacgtaggagatgaagcccaaagcaaaagaggtatcctcaccctgaaataccccatcgaacacggtatcatcacaaagccaacagggagaagatgacccaaatcatgtttgagaccttcaacacacccgccatgtatgtagccatccaagctgtactctccttgtacgcttcttagcttatttgggttctttatcactgtcctgattaaggctgaatcagaacaccatcacttccactcacacgacagtagtaagacacagaacatagtagttaatactggaaagtaacccaccatgaatccgaacaatcgaagtgaacatgatacaataaaaactactgaaaataatgaggtgccaactaaccatgttcaatatcctttagcggaaactccaaatccaacactagaagatttaaattataaagagtttttaagaatgactgcagataataatacggaagcactagatagctctacaacaaaagatgtcattcaaaaaggcatttccgtagtaggtgatctcctaggcgtagtaggtttcccgtttggtggagcgcttgtttcgttttatacaaactttttaaatactatttggccaagtgaagacccgtggaaggcttttatggaacaagtagaagcattgatggatcagaaaatagctgattatgcaaaaaataaagctcttgcagagttacagggccttcaaaataatgtcgaagattatgtgagtgcattgagttcatggcaaaaaaatcctgtgagttcacgaaatccacatagccaggggcggataagagagctgttttctcaagcagaaagtcattttcgtaattcaatgccttcgtttgcaatttctggatacgaggttctatttctaacaacatatgcacaagctgccaacacacatttatttttactaaaagacgctcaaatttatggagaagaatggggatacgaaaaagaagatattgctgaattttataaaagacaactaaaacttacgcaagaatatactgaccattgtgtcaaatggtataatgttggattagataaattaagaggttcatcttatgaatcttgggtaaactttaaccgttatcgcagagagatgacattaacagtattagatttaattgcactatttccattgtatgatgttcggctatacccaaaagaagttaaaaccgaattaacaagagacgttttaacagatccaattgtcggagtcaacaaccttaggggctatggaacaaccttctctaatatagaaaattatattcgaaaaccacatctatttgactatctgcatagaattcaatttcacacgcggttccaaccaggatattatggaaatgactctttcaattattggtccggtaattatgtttcaactagaccaagcataggatcaaatgatataatcacatctccattctatggaaataaatccagtgaacctgtacaaaatttagaatttaatggagaaaaagtctatagagccgtagcaaatacaaatcttgcggtctggccgtccgctgtatattcaggtgttacaaaagtggaatttagccaatataatgatcaaacagatgaagcaagtacacaaacgtacgactcaaaaagaaatgttggcgcggtcagctgggattctatcgatcaattgcctccagaaacaacagatgaacctctagaaaagggatatagccatcaactcaattatgtaatgtgctttttaatgcagggtagtagaggaacaatcccagtgttaacttggacacataaaagtgtagacttttttaacatgattgattcgaaaaaaattacacaacttccgttagtaaaggcatataagttacaatctggtgcttccgttgtcgcaggtcctaggtttacaggaggagatatcattcaatgcacagaaaatggaagtgcggcaactatttacgttacaccggatgtgtcgtactctcaaaaatatcgagctagaattcattatgcttctacatctcagataacatttacactcagtttagacggggcaccatttaatcaatactatttcgataaaacgataaataaaggagacacattaacgtataattcatttaatttagcaagtttcagcacaccattcgaattatcagggaataacttacaaataggcgtcacaggattaagtgctggagataaagtttatatagacaaaattgaatttattccagtgaattaatctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagaaggcaggatgaccacggattaggcgcgtatgttaagagaaaggcagtactttaagcacgaagtgcttcactggtttgaaggaatttaaagccaggttaacaacaaaatttgagttttcggggagggagggcccccccccccc

SEQ ID NO: 475 - RNA, 3034 nt, synthetic construct
  source 1..3034: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtggctacgagatggcactgcaggatgtgaagaatcctacatattcaacccagataataaacgctctgtcgaccccatgtacaatatggagttaagcagagctaagtctagaatgggcatgtctgctggttcatcttcttatgaagagtcttacagtgcacagggcaacgccgtcaagaagctcaaggactctcaattcgagtaatcagcctacccgtagtacacttcaatggttcattgcacgcggcctcgccgcattctgtatagctagtgatataatagatgtaagactgttgttggcgtgtgtggagcgtatgtgcgagcgattgtgaaaaccatggtcggtatgggacaaaaggactcatacgtaggagatgaagcccaaagcaaaagaggtatcctcaccctgaaataccccatcgaacacggtatcatcacaaagccaacagggagaagatgacccaaatcatgtttgagaccttcaacacacccgccatgtatgtagccatccaagctgtactctccttgtacgcttcttgcggaagaacttgaaggtttgctacacagtcaaatatgtactgcagaagatcccagcttgctgcagtactcaatcaaaggtaaacctgagactcttgcctactatgatcccttgggcccgaaattcaatactcctctttatcttcaaatgctcccgcttctaaaagacaatcctatctttcggaagccatttgtatttgggacagaagccagtagaactctaggatcggatgccatttgctgcacgccaaaaatacatcgagcagatcttcgccttcgagtaaagctaccacttctatctattatctactataccccagagtcaaatatcatcgtgacgaaaactgtggcgagcctgagaaagattgtgcaaagtctcaacattttcgaagacccctacgttttgacactaaaaaggagtgatagcgaaaaaagtcaacgtgagctggcgaaagtactcaagagtactagaagatgcgccatatggcagaccaaatactacttcacccggtcctggaatgcacaatctagagatacctatgggtcctggggcacatagaattggaacgccgagtgatcaattgcaagctcaaccatcttattcggtcgaacatttagatcaaaatcaataccatcagcgcatgcccctcaatcccaggcgaagttgatggagcaaaagaagttcatgaaaattggcttgtctacagaagctttccgatcctacgtcccaatcatacaaatggaggtggaaaactttatgaagcgttcttcggcgttcaaaggtccaaagggaactgctgacattggtcccgctatggctgaaatcaccatctacactgcttcgcacactctgcaaggaaaggaagtccgcgatcgattcgatacctcctttgcctctctctaccacgacctgtctggctaagcctagtcaattgaatgcgttcattcgttatagttcacagcagactgaaagtcatgatacgttaacagagacaactcgaaatattggcatcatagctcatatcgatgcaggcaaaactacaactactgagcgtatgctctattacagtggctatactcgacgcataggagacgttgtctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagaaggcaggatgaccacggattaggcgcgtatgttaagagaaaggcagtactttaagcacgaagtgcttcactggtttgaaggaatttaaagccaggttaacaacaaaatttgagttttcggggagggaggg

SEQ ID NO: 476 - RNA, 3119 nt, synthetic construct
  source 1..3119: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgtagcttatttgggttctttatcactgtcctgattaaggctgaatcagaacaccatcacttccactcacacgacagtagtaagacacagaacatagtagttaatactggaaagtaacccaccatggctcaaataaacaacatggctcaaggcatccagactcttaacccaaactccaacttccataagcctcaagtgcctaaatcctcatcctttttagttttcggaagcaagaaacttaagaatagcgctaatagcatgcttgttcttaaaaaggattccatttttatgcaaaaattctgcagttttagaatatcagcatccgtcgctaccgcctgtatgctccatggggctagttctaggccagccacagctagaaagagctcagggttgagtggaaccgtcagaatccctggggataagagtatttcacacagatccttcatgtttggaggtttggcatccggagaaacccgtatcaccgggctcctggaaggtgaggacgtcattaacaccggaaaggcaatgcaggctatgggggctcgtattagaaaagaaggtgacacgtggattattgacggcgttggaaatggaggtcttctcgctcccgaagctcctctcgacttcggtaacgccgctaccggatgcagattgaccatgggtttggttggtgtttatgatttcgactcaacttttatcggtgatgcatctttaacaaaaagacctatggggcgagtcttgaatccattgagggagatgggcgtacaagttaaatctgaagatggcgaccgactgccagtcactcttagggggccaaagactcccactcccataacttatcgtgttcctatggcatcagcacaggttaagtctgctgttcttttagctggtcttaatacacctggaatcacaactgttattgagcccattatgacatgtgatcatacggagaagatgttgcaggggttcggagccaatttgactgtggagacagatgctgatggtgtgaggactattagactggaaggacgtggcaaactcaccggtcaagttatcgatgtcccaggtgatccttcctctaccgcctttcctttagttgcagccctgctcgtgccaggctctgatgtgaccattctcaatgttctgatgaacccaactaggacgggacttatactcacactgcaggagatgggagcagatatcgaggtaataaatctccgtctcgcaggaggtgaggacgttgcagatcttcgtgttcgttcctctacattaaagggtgtcaccgttccggaagatagggccccaccaatgattgatgaataccctatccttgcagtcgctgcagcctttgctgaaggtgctacagtaatgaatggccttgaggaacttagggtgaaggaatctgataggctcagtgcagtggctaatgggttgaaattgaatggtgtagactgtgacgagggtgaaacttcacttgttgtgcgaggtagacccgatggcaagggacttggcaacgcctcaggtgccgccgttgctactcacttggatcataggattgctatgagcttcttggtgatggggttagtgtctgagaacccggtgactgtagacgatgcaacaatgatcgccacaagtttccctgagtttatggatcttatggctggactcggtgccaaaattgaactgagcgatactaaggcagcctaatctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 477 - RNA, 2090 nt, synthetic construct
  source 1..2090: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgtagcttatttgggttctttatcactgtcctgattaaggctgaatcagaacaccatcacttccactcacacgacagtagtaagacacagaacatagtagttaatactggaaagtaacccaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtcagcccccgccaccagcggacgggactgggctccacgctctacacccatctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatttgatgatctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 478 - DNA, 20 bp, synthetic construct
  source 1..20: mol_type = other DNA
catcgagacaagcacggtca

SEQ ID NO: 479 - DNA, 20 bp, synthetic construct
  source 1..20: mol_type = other DNA
ccagggacttcagcagatgg

SEQ ID NO: 480 - DNA, 2906 bp, synthetic construct
  source 1..2906: mol_type = other DNA
taatacgactcactataggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaaggcacacagactcgaagaggaattagagttcatacaatttggacctgaagagtgtgttccagatttaaacaaagtggacatcagaaccatcagaaacatgatgctgttgtttgaccaagaccactgtcatttggacgtgaccactgacgatgttgtcaaatacctacaacaaagtcaattgcaaagcacagaaccgttttacggtggacctagtaaaatgtactatgccaattgcaggccgatgttactaccaccatcaaaacaagacggcacaaaaactgaagctgcctcaaaattgttgacaggtttgattaaaaagtttggtggtagtgtcattaacatggttctacttgattgtgtaaacaattataacatgaccccacacgtatacaaaataggaaattcgtatggttacaaagccatggaattgccaaatgtagaagcagcgatgacgtgttcgtgttgtggaatcacaaatttagtgtggttattagacgaaactgaaggattgactaagtcaagatgtggagtctgtttgcaaccgctattggttagaacaatgatgcctgaatgcattatgtggggcatgttggaggtgattgatattacacaattgcgagtgggagcaatagagttgaacaacgcagagataaccttgcagctggatggtcagccaccattagcaccagccacattgtcaaaactaattgaccaagatctaaggaatttgcggtcagtcatgtcacgcgctatgagtaaaactatatatgtacctaatgggttaactgaatatcagaaaaaagaattggcaattgttgtgccggcatacaagctattgccactcccacttggttcactcttgtactgttcatgtatatgttttgtacacctccaattcagcaacacaatagctccactaggctaaactacacttgtttctgccaacttcctctggctccggccaacaagtaactcgtaatcctgtacaatagcttgtgcacaaagctttcctgataagacagcaccttccattgaagccaagtatttctgtttcgtgtagtcaccagctaaataaaacccctctacaggggatctttgcaagggccgacagggttcacaacctggcacagttttatatacagaccttggagttttgacaacaagaagcgtacaaggagagtacagcttggatggctacatacatggcgggtgtgttgaaggtctcaaacatgatttgggtcatcttctccctgttggctttggggttgagtggagcttcagtgagaaggactgggtgttcttctggagcgacacggagttcgttgtagaaggtgtggtgccagatcttttccatgtcatcccagttggtgatgataccgtgttcgatggggtatttcagggtgaggatacctcttttgctttgggcttcatctcctacgtatgagtccttttgtcccataccgaccataaataaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 481 - DNA, 2242 bp, synthetic construct
  source 1..2242: mol_type = other DNA
cttatcgaaattaatacgactcactataggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgacaattaccaacaacaacaaacaacaaacaacattacaattacatttacaattacatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggtaccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaatacccatacgatgttccagattacgcttgatctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 482 - DNA, 2330 bp, synthetic construct
  source 1..2330: mol_type = other DNA
cttatcgaaattaatacgactcactataggtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgaaataacaaatctcaacacaacatatacaaaacaaacgaatctcaagcaatcaagcattctacttctattgcagcaatttaaatcatttcttttaaagcaaaagcaattttctgaaaattttcaccatttacgaacgatagcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggtaccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaatacccatacgatgttccagattacgcttgatctcagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 483 - DNA, 236 bp, Oryza sativa alphaendornavirus
  source 1..236: mol_type = other DNA
agtggtttgagtttatgagagaggatggtgtaggagggatatgtgatgtaaaaatggatatgaagatgaaatggtgggagtaagtagatgggtggggatttgatgtcgtacaagacatttcaaatttatgtattaaacgcagcaacaacagggggggcggacgcccttctaaaataaaaatgatcaaatcaagtacgatcttgatcaaatcaaaccctattgaagggtttgaaaga

SEQ ID NO: 484 - DNA, 159 bp, unidentified
  source 1..159: mol_type = other DNA; note = unclassified Endornaviridae
ctcgtacaagacatttcaaatttatgtaaattgaacgcagcaacaacagggggggggcggagacgcccccccccttttaaaaataaaaatgatcaaatcaagtacgatcttggtttgatcaaatcaaaaacccccattataaaagggtttttgaaaaga

SEQ ID NO: 485 - DNA, 159 bp, unidentified
  source 1..159: mol_type = other DNA; note = unclassified Endornaviridae
gtcgttcaagacatttcaaagttatgtaaattgaacgcagcaacaacagggggggggcggagacgcccccccccttttaaaaataaaaatgatcagatcaagtatgatcttggtctgatcaaatcaaaaacccccactataaaggggtttttgaaaaga

SEQ ID NO: 486 - DNA, 140 bp, Oryza sativa alphaendornavirus
  source 1..140: mol_type = other DNA
atattataactaactctgttcaattaatttattaaaggatggggcaccccctcccaaacccggcaaaatcccatcccatacatcccaccatatcatctatatccatttcacttacatcccatcccccaacccttttaaac

SEQ ID NO: 487 - DNA, 77 bp, unidentified
  source 1..77: mol_type = other DNA; note = unclassified Endornaviridae
tattataactaactctgttctgttaatttatttttaaaaggatggggcacccctcccaaaccccgagatcggaagag

SEQ ID NO: 488 - DNA, 69 bp, unidentified
  source 1..69: mol_type = other DNA; note = unclassified Endornaviridae
agttcatgaatagctgatttcaattaatttatttttaaaagggtggggtccccctcctcaaccccggcc

SEQ ID NO: 489 - DNA, 711 bp, Bell pepper alphaendornavirus
  source 1..711: mol_type = other DNA
aaagtgttggattggttgagagacaggccagatagtaataaggtagcagcagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaaacaaatgttaaaaccaaacattgtttatgctgacggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaaccacagctctgggaaatgctataaccaatatgttggtgcatagacgattagttaaccggctcggacacaatctaagattgtttttaattttaggagatgatggtctcatgtttaccaatacgagcatagatctcagtcgactaaacaatgagacaaagatcaaacacaatatg

SEQ ID NO: 490 - DNA, 711 bp, Cucumis melo alphaendornavirus
  source 1..711: mol_type = other DNA
gatgtgaagaaatggattgaagagaataaagattgcgagaaaattgaacgagagttaattgacctattgtgtggagaattgatatcgaaaccaatcaatgatgttaatgtacatcttaaattagagagtttgctaaaagaaaattttacaataatgaccatgcaacaacaagcaagaatcatcgtttggcagagaaaagccgtttgtgctatctactcaaacctctttgtagaagttaaacgtagattgaaagaagtgttgcacagaaaaattgtatatgcagatggactacgaccagatgaaatatcagccagggtaaggctagtcaagaatgtagctggattctttgaaaatgatttaactaaacaagatagacaaactgataaacctattattgaagtagaattgatgatatatgatttattgggagttcatccaaacgtaatagcatcttggaaagaaatgcatgaggtgtggagatttaagtcaaatttgtactggggtcaaggagaaggtatgcggttgactggacaggcaacgactgcacttggcaattgtttgaccaatcttcaagtacaccaaaactttacaaagacaaatttctgtatattgcaactagggttatttttaggggatgatatgtgtatggtgttcagtgagaagccagatacgtcaaatctcagaaaagatattgcaaccagcttcaacatg

SEQ ID NO: 491 - DNA, 711 bp, Bell pepper alphaendornavirus
  source 1..711: mol_type = other DNA
aaagtgttggattggttgagagacaggcctgatagtaataaggtagcagtagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaaacaaatgttaaaaccaaacattgtttatgctgacggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaaccacagctctgggaaatgctataaccaatatgttggtgcatagacgattagttaaccggctcggacataatctaagattgtttttaattttaggagatgatggtctcatgtttaccaatacgagcatagatctcagtcgactaaacaatgagacaaagatcaaacacaatatg

SEQ ID NO: 492 - DNA, 711 bp, Bell pepper alphaendornavirus
  source 1..711: mol_type = other DNA
aaagtgttggattggttgagagacaggcctgatagtaataaggtagcagcagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaaacaaatgttaaaaccaaacattgtttatgctgatggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaaccacagctctgggaaatgctataaccaatatgttggtgcatagacgattagttaaccggctcggacataatctaagattgtttttaattttaggagatgatggtctcatgtttaccaatacgagcatagatctcagtcgactaaacaatgagacaaagatcaaacacaatatg

SEQ ID NO: 493 - DNA, 711 bp, Bell pepper alphaendornavirus
  source 1..711: mol_type = other DNA
aaagtgttggactggttgagagataggcctgacagtaacaaagtggcagcagaactagaagtgatactggaagagggaatgcaactacatgccattaacaagctaaatgtgcacctgaaattggaatcattattaaagtctgagccagcaagtagtttgaaacaagtaaaagctagagcgttgttatggcaatgcaaaggttactgtgcaatatttagtcacatttttaaagaggcaaaagtgagacttaagcaaatgttaaaacccaatatagtttatgctgacgggctgagggcagacgagctatccgcacgagtgagactgaccacaggtgtaaaatatttattagaaaatgacttggcacaacaagacaaacaaactgaccatgaaataatcaaatttgaaatggcactgtataaagtgctaggggtgcatgatgatgtgataaccttgtggcacaacagtcattttaactggaaatacaagtccaggacagtgagaggagagggagatgccatgagattgactggtcaagcaactacagctctggggaatgccataaccaacatgttggtgcatagaagattagttaatcgactcgggcacaatttgagattgtttctgattttgggagatgacggtctcatgtttaccaacacaagtatagatcttagtcgattaaacaatgaaacaaaaatcaaacacaacatg

SEQ ID NO: 494 - DNA, 711 bp, Bell pepper alphaendornavirus
  source 1..711: mol_type = other DNA
aaagtgttggattggttgagagacagacctgatagtaataaggtagcagtagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaagcaaatgttaaaaccaaacattgtttatgctgacggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaactacagctctgggaaatgctataaccaatatgttggtgcatagacgattagttaaccggctcggacataatctaagattgtttttaattttaggagatgatggtctcatgtttaccaatacgagcatagatctcagtcgactaaacaatgagacaaagatcaaacacaatatg

SEQ ID NO: 495 - DNA, 711 bp, Persea americana alphaendornavirus 1
  source 1..711: mol_type = other DNA
gatgtgagggcatggatagaagatagcaaagatagcaacaaaatagtaaaagaattaaaggaactgttagccggggagatgttgataaagcccatgaatgatgtcaacgtccacttaaaactagagagcttgctgaaagctaatccaattaatgtgactaaagaacagcaggcaagagtgatagtgtggcaaaggaagtgtgtatgcgccctgtatgctagattattccttaagatcaaatcacggctaaaagagatattgcatgagaaaattgtgtacgcggatggtctaacaccagatgacatatcagcaagagtcaggttgtgtaacaacgttaatggattcttcgagaatgatctgacaaagcaagacagacaaactgaccgagatatcatcaacatggaaatgcttgtgtatattgtgttgggagccaatccaagcattatatcttcatggagggagatgcacgaagtatggagattcaaatcggccaattactggggtgaaggaaaagagatgcgactatcaggccaagccacaacagcactcggaaacgtgataacgaatttacaggtgcattgcaaatttgtaaagaagaattcaatatccatgcagttgggactatttctaggtgatgacatgtgtatgttgttcagcgagaaaccatcaatcaaaaatttacgtaatgatatagcctgtgaattcaatatg

SEQ ID NO: 496 - DNA, 711 bp, Bell pepper alphaendornavirus
  source 1..711: mol_type = other DNA
aaagtgttggattggttgagagacaggcctgatagtaataaggtagcagtagaactagaagtgatattggaagagggaatgcaactacatgccattaacaggctaaatgtacacctgaaattggagtcattgttaaaggctgaaccagcaagtagtttaaaacaagtgaaagctagagcgttgttatggcaatgtaaaggttactgtgcaatttttagtcatattttcaaagaggcgaaagtgagactcaagcaaatgttaaaaccaaatatagtttatgctgacggattgagagcagatgagttgtccgcaagagtaagactaaccacaggtgtaaaatatttattagagaatgacttagcacagcaagacaaacaaactgaccatgaaataattaaatttgaaatggcactgtacaaactgttaggggtgcatgacgacgttataaccttgtggcacaacagtcatttcaattggaaatacaaatccaggacagtaggaggagagggagatgccatgagattgactggtcaagcaaccacagctctgggaaatgctataaccaatatgttggtgcatagacgattagttaaccggctcggacataatttaagattgtttttaattttaggagatgatggtctcatgtttaccaatacgagcatagatctcagtcgactaaacaatgagacaaagatcaaacacaatatg

SEQ ID NO: 497 - DNA, 711 bp, Oryza sativa alphaendornavirus
  source 1..711: mol_type = other DNA
gatgttaaaaattggattgaagaaaataaagattgttttggtgttgaaaaagagctaaatgatttactagcaggcgaattattaatcaaaccattgaatgatgttaatgtgcatttgaaattggagtctttactaaaggacaagcatatctccattatgaaggaacagcaagctagaataatagtatggcaaaggaaagcagtttgtagtttatttgccaaattgtttgtaagatgcaaagacagactgaaaactttacttgtggatcatatactttacgtagatggattgagaccagatgaaatatcagccaaattaagacaaatatctgatgtatttggattttttgaaaacgacctgactaagcaagatagacaaactgacaaacccattttagaagtggaaatgttgatgtatcttatgttgggcgttcatcctaacatcatatctagttggcgttcaagtcatgatgattggagattcaaatctacaaattattggggtaagagcacggcaatgagattaacgggacaagctacaaccgcactaggaaattgtatcactaatatgcaagtacactcaaaatttgtaatcaaaaataaatattggttaaagtttgctttatttcttggggatgatatgtgtatgggtttctcacacaagccaaacacacagcacttacgccaggatatagcttgtaaatttaatatg

SEQ ID NO: 498 - DNA, 711 bp, Oryza rufipogon alphaendornavirus
  source 1..711: mol_type = other DNA
gacgttaaaaactgggtggaagagaataaggattgttttggcgtggaaaaagagttaaatgatctattagctggggaattgttaataaaacctataaacgatgtgaacgtacatttaaaattagaatcattattgaaagaaaaacacatatctttgatgaaagagcaacaggccagaataatagtgtggcaaaggaaggcagtttgtggtctgtttgctaaactttttgtgagatgtaaggaaagattgaaaaccctactattggaccacatactctatgtagatggactaagaccagatgaaatatcagccaaactgagacaaatatccaatgtgtttggtttcttcgaaaatgatttaactaaacaagacagacagactgataaaccaatacttgaagtggaaatgttgatgtacttgatgttaggtgttcaccctaatattatcgctagctggcgtgcaagccatgaagattggagatttaaatcaacaaactactggggcaagagtacagccatgagactcactggacaagctaccacagcccttggaaattgtatcacaaacatgcaagttcactcgaagtttgtcattaagaataagtactggttaaaatttgctttatttcttggcgatgacatgtgtatgggtttttcacacaaaccaaacacacaacatttacgccaggacatagcttgcaaatttaatatg

SEQ ID NO: 499 - DNA, 711 bp, unidentified
  source 1..711: mol_type = other DNA; note = unclassified Endornaviridae
gatgtgaaaaattggatagaacagaataaagattgtgagaaaatagagaaagaattaattgatttgttatgtggagaattaatcactaaaccaattaatgatgtcaatgtacatctgaaactggagagtttgttaaaggaaaattttacaataatgacaatgcaacaacaagctagaatcatagtgtggcagcgtaaagctgtgtgtgcaatctactctaatttgttcgtagaggtcaaaagacgattgaaggaagtattgcacagaaaaatagtatatgcggatggtttacgaccggatgaaatatctgccagagtccgattggttaaaaacgtagccggatttttcgaaaatgatttgactaaacaagatagacaaactgataaacctattatagaagtggaattgatgctttatgatttgttaggggtgcatccaaatgtcattgcatcctggaaagaaatgcatgaagtgtggagattcaaatccaacctttattggggacaaggtgaaggtatgcgattgaccggtcaagccaccactgcattaggcaattgtataacaaacttacaggtccatcagaagttcacaaagactaactttcaaacattgcaattgggtttgtttttgggggatgacatgtgcatgatattcagtgaaaaacctgatacttctaatttgcgaaaagacatcgctgcagaatttaatatg

SEQ ID NO: 500 - DNA, 711 bp, Bell pepper alphaendornavirus
  source 1..711: mol_type = other DNA
aaagtgttggattggttgagagacaggccagatagtaataaggtagcagtagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaaacaaatgttaaaaccaaacattgtctatgctgacggattgagagcagatgagttgtccgcaagagtaagactaaccacaggtgtaaaatatttattagaaaatgacttagcacagcaagacaaacaaactgaccatgaaatcattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaaccacagctctgggaaatgctataaccaatatgttggtgcatagacgattagttaaccggctcggacacaatctaagattgtttttaattttaggaggtgatggtctcatgtttaccaatacgagcatagatctcagtcgactaaacaatgagacaaagatcaaacacaatatg

SEQ ID NO: 501 - DNA, 714 bp, unidentified
  source 1..714: mol_type = other DNA; note = unclassified Endornaviridae
gaaatcagaacatggttggcagcaagacctgacgggctgcaagttgctgccgagctggaagccataatggccgaagggtttgaggtgaaccccatcaacagggctaaggtgcacgtgaagctagagtcactactaaaagacgggtacgacagtgtaggcaacagggaggtggaggcgaggatcatcgtttggcaaaggaaaggattctgtgcaatattctcccccatattcctgcaagcaaagtccagattgaagtcactgttaaatgataaaaccttatacgctgacggtctgaccgcaggagaactatccgcaagagccaggctattgccaggtggactgtggatgatggaagatgacctgagtaagcaagacaggcagacggaccgcaacttgatagagtgtgagatggaatgctacaaacaactgggcgtggatgagcgagtactcaggttctgggaaaggacacatcaaaactggaaattcaagggatcaagcgtctcggggatactggatgcccagagattaactggacaagcaaccaccgccttaggaaacgccttagtaaacatgatggtgcacagtagattggtagaggagaacaagagacacgtgagattggtctgcatacttggagatgacaacttgatcctgtcagagcacaaaatcagctcttggagacaggtgaaagacagcaaagactactataacatg

SEQ ID NO: 502 - DNA, 711 bp, unidentified
  source 1..711: mol_type = other DNA; note = unclassified Endornaviridae
aaggtacttgattggttgcgagaccggccagacagtaataaagtagcagaagaagtagaaaccatcctgcaagagggaatgcagttgcattcaataaacagattgaacgtacacctaaaactggagtcattgcttaaggctgaacctgcttcaagtttaaagcaggtaaaggccagggcactactgtggcaatgcaaaggttactgtgcaatatttagtcacatattcaaagaggcaaaggccagactaaagcaattgctaaaaccgaccattgtgtatgcagacggattgcgtgccgacgagttgtctgcccgtgtgcggctcacaactaatgtgcattacttgatggaaaatgatttagcacagcaagacaaacagacagatcacgacattataaagtttgaaatggagttatatagattattgggagtgcatgatgatgtgataaatttgtggcacagtagccatttccattggaagtacaaatcaagaacagtgaaaggggctggggacgcaatgcgtttaacagggcaagccaccacagcactaggaaatgccatcactaatttgctagtgcacaggaaagtggttgacaggctgggcagcagcttgaggctgtttttagtgctgggcgacgatggactgatgtttacaagtgaaaaaatagatttgagcaaactaaacaatgaaaccaaaataaagcacaacatg

SEQ ID NO: 503 - DNA, 711 bp, Cucumis melo alphaendornavirus
  source 1..711: mol_type = other DNA
gatgtgaagaaatggattgaagagaataaagattgcgagaaaattgaacgagagttaattgacctattgtgtggagaattgatatcgaaaccaatcaatgatgttaatgtacatcttaaattagagagtttgttaaaagaaaattttacaataatgaccatgcaacaacaagcaagaatcatcgtttggcagagaaaagctgtttgtgctatctactcaaacctctttgtagaagttaaacgtagattgaaagaagtgttgcacagaaaaattgtatatgcagacggactacgaccagatgaaatatcagccagggtaaggttagtcaagaatgtagctggattttttgaaaatgatttaactaaacaagatagacaaactgataaacctatcattgaagtagaattgatgatatatgatttattgggagttcatccaaacgtaatagcatcgtggaaagaaatgcatgaggtgtggagatttaagtcaaatttgtactggggtcaaggagaaggtatgcggttgactggacaggcaacgactgcacttggcaattgtttgaccaatcttcaagtacaccaaaactttacaaagacaaatttctgtatattgcaactagggttatttttaggggatgatatgtgtatggtgttcagtgagaagccagatacgtcaaacctcagaaaagatattgcaaccagcttcaacatg

SEQ ID NO: 504 - DNA, 711 bp, Bell pepper alphaendornavirus; identical to SEQ ID NO: 494
  source 1..711: mol_type = other DNA

SEQ ID NO: 505 - DNA, 711 bp, unidentified
  source 1..711: mol_type = other DNA; note = unclassified Endornaviridae
aaggtactcgattggttgcgagaccggccagacagtaacaaagtagcagaagaagtagaaactatcctgcaagagggaatgcagttgcattcaataaacagattgaacgtacacctcaagctggagtcattgctcaaggctgaaccggcttcaagtttaaagcaggtaaaggccagggcactactgtggcagtgcaaaggttactgtgcaatatttagtcacatatttaaagaagcaaaggccagactaaagcaattgctaaaaccgaccattgtgtatgcggacggattgcgtgccgacgagttgtctgcccgtgtgcgactcacaactaacgtgcgttacttgatggaaaatgatttggcacagcaagacaaacagacagatcacgacattataaagtttgaaatggagttatatagattattgggagtgcatgatgacgtgataaatttgtggcacaatagccattttcattggaaatacaaatcaagaacagtaaagggggctggtgacgcaatgcgtttaacagggcaagccaccacagcactaggaaatgccatcactaatttgctagtgcacagaaaagtagttgacaaactgggcagcagcttgaggctgtttttggtgctgggcgacgatggactaatgtttacaagtgaaaaaatagatttgagcaaactaaacaatgaaaccaaaataaagcacaacatg

SEQ ID NO: 506 - DNA, 711 bp, unidentified
  source 1..711: mol_type = other DNA; note = unclassified Endornaviridae
aaggtactcgattggttgcgagaccggccagacagtaacaaagtagcagaagaagtagaaactatcctgcaagagggaatgcagttgcattcaataaacagattgaacgtacacctcaagctggagtcattgcttaaggctgaaccggcttcaagtttaaagcaggtaaaggccagggcactactgtggcagtgcaaaggttactgtgcaatatttagtcacatatttaaagaagcaaaggccagactaaagcaattgctaaaaccgaccattgtgtatgcggacggattgcgtgccgacgagttgtctgcccgtgtgcgactcacaactaacgtgcgttacttgatggaaaatgatttggcacagcaagacaaacagacagatcacgacattataaagtttgaaatggagttatatagattattgggagtgcatgatgatgtgataaatttgtggcacaatagccattttcattggaaatacaaatcaagaacagtaaagggggctggggacgcaatgcgtttaacagggcaagccaccacagcactaggaaatgccatcactaatttgctagtgcacagaaaagtagttgacaaactgggcagcagcttgaggctgtttttggtgctgggcgacgatggactaatgtttacaagtgaaaaaatagatttgagcaaactaaacaatgaaaccaaaataaagcacaacatg

SEQ ID NO: 507 - DNA, 711 bp, unidentified
  source 1..711: mol_type = other DNA; note = unclassified Endornaviridae
aaagtactggactggctgagtcaacgccctgacggcaacaagatagctgcagaattggaagggattctcagctccggcatggaagttaacccgatcaacaacatcaacgtgcacctcaagttggagtctttgctgaaagaagaacctgccaaatctatcaagcaggtcaaagcacggccattgatgtggcagtgtaaggggtactgtgcagtcttctctcactgcttcaaagaggttaaacaacgactcaaacaattacttaagcacaacatagtgtacactgacgggctgagggcggatgagctggcagcccgcgtcagggccgcaggtgatttcaaatatatatttgagaatgatttggcacagcaagacaagcaaaccgacatggaaataatagaatttgagatgtatttgtacaagaaacttggtatgaacccaggaatggtgaacttgtggaaaaattgccaccgacattggaagtacaaatcaaggacggtcatgggagtgagagatgctatgagactgactggtcaggctacaacagcattgggtaatgtaataacaaacatgcttgtgcacagacgaataacccagcagttgcaagattctcttcgattgtttttgttactaggtgacgacggactaatgttgcttgattcttggattaatgttgatcatctgaacacggaacttaaacatcatcacaacatg

SEQ ID NO: 508 - DNA, 705 bp, unidentified
  source 1..705: mol_type = other DNA; note = unclassified Endornaviridae
caagcatggattgataaacacaacatgcctgcatctgtgaaaagagatataagagaaatgctggagatggggtgggaacaaagaccaatcaactctatggaagtgcatgggaagacagaacaaacaacaaaattaaaaaatgcaaggtggttcaatgaggtggtcacacgtagcattgttgctgcaccttatgcagtatcagcgctttttgcagaggtgttcatggaaatgaagcaaagatttaagtctgtgttgcgatcggatgtgttttattcagatggtagcacgccagcagaattggcagctctggtgcgccaatgcggcgaatttaaatactgtacagaagacgacttgacacagcaagatggtcaaactgatagacaaatcataaacattgagatggaaatatacaaaatgcttggtcttagtgggaacgtgcttgcattctacagacaatgccacgacaattggaaatggaaaggtcacggtatatcaggggtgtgggatgcaatgcgattaagtggtcaggtgacgacagctcttgggaatgctataactaatttgatagttcacaacaggttcatgttacgcaacagaaactcgataaagaaagtactatttttaggagatgatatcatattcttgtccaataccaaattaaaagtggcaaatcacggtactgaaaccaaagagttgtacaatatg

SEQ ID NO: 509 - DNA, 711 bp, Bell pepper alphaendornavirus
  source 1..711: mol_type = other DNA
aaagtgttggattggttgagagacagacctgatagtaataaggtagcagtagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaagcaaatgttaaaaccaaacattgtttatgctgacggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtgagaggagagggagatgccatgagattgactggtcaagcaactacagctctgggaaatgctataaccaatatgttggtgcatagacgattagttaaccggctaggacataatctaagattgtttttaattttaggagatgatggtctcatgtttaccaatacgagcatagatctcagtcgactaaacaatgagacaaagatcaaacacaatatg

SEQ ID NO: 510 - DNA, 717 bp, unidentified
  source 1..717: mol_type = other DNA; note = unclassified Endornaviridae
gccatcaaagcatggttaacctctcgaccagatgccgtgaaaattgcggccgaagtagacgcaataatggtagagggatttgaaactaatcagttaaatacaatcaaagtacatttgaaactggagtctttgttaaaagaaaatccagttaaatatatgaaacaattgcaaccacgtatcatagcatggcaatctaaaggaatttgtgctctatatagtcattgctttaaaaacataaaacaaagattcaaatctatgttaaaacaaaatgtcatttacaccgatggtatgacacctgacaatttaggtgaacggtgtcgaaatgtacaaattaagccaacatacaactttgtagagaatgatttgacaaagcaagacaggcaaaccgatcacaatttgattgactttgaaatggccatttacattaaattaggtgcagataaaaatttgatagaatcttggttacgagtacacaaaaattggagagccaggggcacatatattgtaatgcacggagatgccatgagattgaccggtcaagctaccacagccttgggtaatgccattgttaatttgatatgtcacatggatttagttgaaagactgtcaacaaggttaatattaatgttaattttgggagatgacaacgcctttttggtggacggggaaatagataccgtgacactaagacgttggatcgcagacaaatgcaacatg

SEQ ID NO: 511 - DNA, 711 bp, unidentified
  source 1..711: mol_type = other DNA; note = unclassified Endornaviridae
aaaactaaacaatggatagctaaacaccacaacgcctcaaaagttttaaaagatcttgagacgtttttggtagaaggtaaccaaataaggtccatagcagatataaatatacatttaaaattggaatcattgttaaaggacccagctatacaatcattcaaacaacaacagccaaggtcaattatgtggcaacattattacgttgcggcaatatacagcccgatatttatggaagttaaaaaaagattaaaatttttacttaaagagcatataatatatgcagatggttataaagccagtgatttaagtaaagtattatctactatcagggctggtaaatactattacgaaagcgatttaaaaaaacaagacagacagacagataaacccttattggatgtggaaatggagatttacagactattgggagtggatgacaaagtactaaattcatggagaacagtacacgaaaagtggcggttcaagggcacttacagcaaaggattatgccaagaaatgcgcactaccggacaagctactactgcaataggcaacgtcataactaacatgcaagcaaatttaccagtgattgaaaaatacggtgctactattaaattaatgatgatgttgggggacgacaacttaatgaatatggaggttttagtaaacactaaagaagcggagaaaaatatagctgtcacatgtaatatg

SEQ ID NO: 512 - DNA, 711 bp, Bell pepper alphaendornavirus
  source 1..711: mol_type = other DNA
aaagtgttggattggttgagggacaggcctgatagtaataaggtagcagcagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaaacaaatgttaaaaccaaacattgtttatgctgatggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaaccacagctctgggaaatgctataaccaatatgttggtgcatagacgattagttaaccggctcggatataatctaagattgtttttaattttaggagatgatggtctaatgtttaccaatacgagcatagatctcagtcgactaaacaatgagacaaagatcaaacacaatatg

SEQ ID NO: 513 - DNA, 714 bp, unidentified
  source 1..714: mol_type = other DNA; note = unclassified Endornaviridae
gactttagaaactggatatatggacacaagaacgctcacaaggtaataacagagctagaatcattaagcgcggaagggcctctagtgaaccctttcaatttctttcgcagtcatgtcaaactagaaagcattaataaagaaaatcctataatggatttcaggcaagctgcaccacgagctatcgtgtggttgccgtactgcatgccagccttgtttagctacatgtttaaaatggcgagcaacaggttcaagcttatactaaggaaagaagtgcactatgcctcagggctggacgtaaacgatatcgaacaaatagtacgaaacacagacgacagtgatgttttcttttttgataacgacattagcaaaatggactctcagatagacaaagacttgatagaggttgagtgggaagtgctaagtctaatgggaatttcaccggacgtactcgaatcatataagaccctgaaacgaaactggcggatttctaacaaatatattagcgtgaccgggaaatggctaaggcattccggtgaaccaaccactgccctaggaaacgggataataaatctggcgataacggcattgtcaacgaccgaaacaaggagacaggaccttaaactatgtttattcatgggggacgacatggtaatgctaaccaagaaaaaggaagacgtattgcaggtgaagaagaaaggtaaacacctagctaac

SEQ ID NO: 514 - DNA, 711 bp, Phaseolus vulgaris alphaendornavirus 2
  source 1..711: mol_type = other DNA
aaagtgctagattggttaagggaccgtccggacagtaataaaatagcagaagaactgaacaatattttagctgagggtatgcaactgcacccaatcaacaaattaaacgtgcacttgaaattggaatcattgttgaaatcagagccagcgtcaaatttaaaacaagtcaaagctagagctttagtttggcagtgtaaaggatattgcgccatattcagtcacgtgttcaaagaagttaaagtcagactcaaagatttgttgcgaccagaaattgtgtattcagatggcttaagagcggatgaattggctgcaagagtgaggttgaccacaaatgtcaaatttttgctggaaaatgacttggcccaacaagacaaacaaaccgatcatgagataatcaaggttgaaatggaaatttataaattgttaggcgtgtgtcctcacctagtagatttatggaaaaattgtcaccacagttgggcctacaagtctagaactgtagcaggtgtaggtgacgctatgcgactcactggccaagccaccactgccatagggaacgccatcaccaatatgctggtgcataggcggttggttaaaacattgggtcacaacctaagattgtttttggtgttgggtgatgatggattaatgttcacaacaacatgggtggataccactaagttgaataacgagctgaaaaccaatcataacatg

SEQ ID NO: 515 - DNA, 711 bp, Basella alba alphaendornavirus 1
  source 1..711: mol_type = other DNA
gatgtcgaaaattggattaaggcaaataaagattgtccaaaaatagtgacggaaatgttagagaccctttctggaggcttccttaataaacacatcaatgacgtaaacgttcatttaaagttggagagtctttataagccagacccaatcaatgtatggagacaacaacaagcaaggataatagtttggcaaaggaaaagcatttgtgccatttatagctccgcttttaaagcaattaagaataaccttaaagcttgtcttgattataaagtggtatatgcagacggactaagaccagacgagctgtcagcaagggccagactttgcaataatgtggccgggttctttgaaaacgatttgacaaaacaagatagacaaacagatagaccattactggaagtagaaatgatgttgtatgatattctagggctacatccaaaagttatatcttcatggaaagagatgcatgaggagtggagattcaaatctgaacactattggggtactggaaccagcatgaggttaactggacaagcaaccactgctatagggaattgtatcactaacctacaagtgcaccaacaattcgtcaaagacaattgggataacttagagttagcgctgtttttgggagacgatatgtgcatggtattctctcaacaacccagcatcaaggatttgaagtatgacatagctgtaaattacaatatg

SEQ ID NO: 516 - DNA, 711 bp, unidentified
  source 1..711: mol_type = other DNA; note = unclassified Endornaviridae
gatgtgaagaaatggattgaagagaataaagattgtgagaaaattgaacgagagttaattgacctattgtgtggagaattgatatcgaaaccaatcaatgatgttaatgtacatcttaaattagagagtttgttaaaagaaaattttacgattatgaccatgcaacaacaagcaagaatcatcgtttggcagagaaaagcagtttgtgctatctactcaaacctctttgtagaagttaaacgtagactgaaagaagtgttgcacagaaaaattgtatatgcagatggactacgaccagatgaaatatcagccagggtaaggttagtcaagaatgtagctggtttttttgaaaatgatttaactaaacaagatagacaaactgataaacctatcattgaagtagaattgatgatatatgatttattaggagttcatccaaatgtaatagcatcttggaaagaaatgcatgaggtgtggagatttaagtcaaatttgtactggggtcaaggagaaggtatgcggttgactggacaggcaacgactgcacttggcaattgtttgaccaatctgcaagtacaccaaaactttacaaagacaaatttccgtatattgcaactagggttatttttaggtgatgatatgtgcatggtgttcagtgagaagccagacacgtcaaatctcaggaaagatattgcaaccaacttcaatatg

SEQ ID NO: 517 - DNA, 711 bp, Oryza sativa alphaendornavirus
  source 1..711: mol_type = other DNA
gatgttaaaaattggattgaagaaaataaagattgttttggtgttgaaaaagagctaaatgatttactagcaggcgaattattaatcaaaccattgaatgatgttaatgtgcatttgaaattggagtctttactaaaggacaagcatatctccattatgaaggaacagcaagctaggataatagtatggcaaaggaaagcagtttgtagtttatttgccaaattgtttgtaagatgcaaagacagactgaaaactttacttgtggatcatatactttatgtagatggattgagaccagatgaaatatcagccaaattaagacaaatatctgatgtatttggattttttgaaaacgacctgactaagcaagatagacaaactgacaaacccattttagaagtggaaatgttgatgtatcttatgttgggcgttcatcctaacatcatatctagttggcgttcaagtcatgatgattggagattcaaatctacaaattattggggtaagagcacggcaatgagattaacgggacaagctacaaccgcactaggaaattgtatcactaatatgcaagtacactcaaaatttgtaatcaaaaataaatattggttaaagtttgctttatttcttggggatgatatgtgtatgggtttctcacacaagccaaacacacagcacttacgccaggatatagcttgtaaatttaatatg

SEQ ID NO: 518 - DNA, 711 bp, Oryza sativa alphaendornavirus
  source 1..711: mol_type = other DNA
gatgttaaaaattggattgaagaaaataaagattgttttggtgttgaaaaagagctaaatgatttactagcaggcgaattattaatcaaaccattgaatgatgttaatgtgcatttgaaattggagtctttactaaaggacaagcatatctccattatgaaggaacagcaagctaggataatagtatggcaaaggaaagcagtttgtagtttatttgccaaattgtttgtaagatgcaaagacagactgaaaactttacttgtggatcatatactttacgtagatggattgagaccagatgaaatatcagccaaattaagacaaatatctgatgtatttggattttttgaaaacgacctgactaagcaagatagacaaactgacaaacccattttagaagtggaaatgttgatgtatcttatgttgggcgtgcatcctaacatcatatctagttggcgttcaagtcatgatgattggagattcaaatctacaaattattggggtaagagcacggcaatgagattaacgggacaagctacaaccgcactaggaaattgtatcactaatatgcaagtacactcaaaatttgtaatcaaaaataaatattggttaaagtttgctttatttcttggggatgatatgtgtatgggtttctcacacaagccaaacacacagcacttacgccaggatatagcttgtaaatttaatatg

SEQ ID NO: 519 - DNA, 711 bp, unidentified
  source 1..711: mol_type = other DNA; note = unclassified Endornaviridae
gcagtgttagactggattaaatcaaggcctgataataatgcgatagcagaagaaactgagcgcatcttgatggaaggaatgcacgttaatccaattaacatggtgaatgtacacttaaaattggaatccctgcttaaagaagagccagccacaaacttgaaacaggtgaaacctagagcactagtttggcaatgcaaagggtactgtgcaatgttttctcacgcgtttaaacaaatcaaaaacagattgaagatggtattaaacgaaaaagtggtctacgctgatggactgcaggcagatgaggtgtcaaacagactgagactagtggtaggtgatttgtgggtgttagaaaatgatctggcacaacaagatagacagacagatcacgaaatactgaattttgagatggagttgtacttgaaattgggcatgctgcctctgatggttagaatatggagaaatgtgcacaacaactggagatacaaaagcaaaacagtgagtggcatgcgcgacggaatgagattaactggccaggcaacgactgcgttgggaaatgtcatcaccaacttgttagtgcaccgacagttagtacaaaaattaggaaatgcagtcaaattgtttcttgtgttgggtgacgacggaattatgttaacgtcagttaagccagatactgacagactacgtcaatattgtaaacattatcacaacatg

SEQ ID NO: 520 - DNA, 711 bp, Bell pepper alphaendornavirus
  source 1..711: mol_type = other DNA
aaagtgttggactggttgagagataggcctgacagtaacaaagtggcagcagaactagaagtaatactggaagagggaatgcaattacatgccattaacaggctaaatgtgcacctgaaattggaatcattattaaagtctgagccagcaagtagtttgaaacaagtaaaagctagagcattgttatggcaatgtaaaggttattgtgcaatatttagtcacatttttaaagaggcaaaagtgagacttaagcaaatgttaaaacccaatatagtttatgctgacgggttgagggcagacgagctatccgcaagagtgagactgaccacaggtgtaaaatatttattagaaaatgatttagcacaacaagacaaacaaaccgatcatgaaataattaaatttgaaatggcactgtacaaagtgttaggggtgcatgacgatgtaataactttgtggcacaacagtcattttaactggaaatacaagtccaggacagtgcgaggagagggagatgccatgagattgactggtcaagcaactacagctctggggaatgccataaccaacatgttggtgcatagaagattagttaatcgactcgggcacaatttgcgattgtttctgattttgggagatgacggtctcatgtttactaacacaagtatagatcttagtcgattaaacaatgaaaccaaaatcaaacacaacatg

SEQ ID NO: 521 - DNA, 711 bp, unidentified
  source 1..711: mol_type = other DNA; note = unclassified Endornaviridae
aaagtattggactggttacgagaacgacccgatagcaacaagatagctgatgagctggagatgatattgtcgtcagggttggaggtgaacccaataaacaacattaaggtacacctgaaattggaatcattgctgaaagaggtgccggcagagtctataaaacaggtcaaagccagaccattgatgtggcaaaccaaaggttactgtgctttgttttcccacatcttcaaagaggtgaaaatcaggttgaagaacatgctcaaagcaaatattgtatacagtgacggattacgagcggatgagctagcagccagggtaagacaagttagtgatgccaattggctactagaaaacgatttggcccaacaagacaagcaaactgatcaccaaataattgcatttgaaatggcgttgtataaagagttaggagtggacgctggtgtggttaacctgtggcatagatgccattttcactggaaatacaaggcagcaaccgttatggggatccgtgacgcaatgcggctcactggacaagctaccacagcaattggaaatgccatcactaacatgttggtacacagaaaattggcacaacaagctggaaacaatcttaagttattccttatcttgggtgacgatgggttaatgtttacagaagagatggtggacgtgcataaattgaacgcagaaatgaaaacaaagcataacatg

SEQ ID NO: 522 - DNA, 711 bp, Hordeum vulgare alphaendornavirus
  source 1..711: mol_type = other DNA
aaagtaaaagaatggttgcaaggcagacctaatgtagaaagtatagttggggaggttaacaacattctgacggaagggtttatgaaacacccaatcaacaagcttaacgttcacctcaaactggaatctttgttaaaatcacaaccagttgtggaccataggcaaacaaaggccaggattttagtatggcaagcaaaaggcatgtgtgccatatacagcccagtgtttaaaatggcaaaagataggttaaaatcactgctaaatacaaaaactgtgtacgcagatggattgcgtccggaccaattagcactgagagtgacgcaagcggatcctgccaattacatcatggagaacgacctggaacaacaggaccgacaaaccgatgacaaactgttggacgtggaaatggcaatttatcacatgctgggtgtgcaggaagaactgttgtcgttatggaggcagtgccataacaactggaactttaagggaaggtcatgtcgcggagaacgaaactggatgaggctaacaggccaggctaccactgcactaggcaacgcaataaccaatttgtgcgtgcattggcggctgtgcagcaaattgggtaatgattggaaactgtttgtgttattaggagacgatggggcgttgttgaccaacaggacattgtcaaacaaagaagtgaaaacccatggtaaattgttgtacaatatg

SEQ ID NO: 523 - DNA, 711 bp, Hordeum vulgare alphaendornavirus
  source 1..711: mol_type = other DNA
aaagtaaaagaatggttgcaaggcagacctaatgtagaaagtatagttggggaggttaacaacattctgacggaagggtttatgaaacacccaatcaacaagcttaacgttcacctcaaactggaatctttgttaaaatcacaaccagttgtggaccataggcaaacaaaggccaggattttagtatggcaagcaaaaggcatgtgtgccatatacagcccagtgtttaaaatggcaaaagataggttaaaatcactgctaaatacaaaaactgtgtacgcagatggattgcgtccggaccaattagcactgagagtgacgcaagcggatcctgccaattacatcatggagaacgacctggaacaacaggaccgacaaaccgatgacaaactgttggacgtggaaatggcaatttatcacatgctgggtgtgcaggaagaactgttgtcgttatggaggcagtgccataacaactggaactttaagggaaggtcatgtcgcggagaacgaaactggatgaggctaacaggccaggctaccactgcactaggcaacgcaataaccaatttgtgcgtgcattggcggctgtgcagcaaattgggtaatgattggaaactatttgtgttattaggagacgatggggcgttgttgaccaacaggacattgtcaaacaaagaagtgaaaacgcatggtaaattgttgtacaatatg

SEQ ID NO: 524 - DNA, 711 bp, Cucumis melo alphaendornavirus
  source 1..711: mol_type = other DNA
gatgtgaagaaatggattgaagagaataaagattgcgagaaaattgaacgggagctaattgacctattgtgtggagaattgatatcgaaaccaatcaatgatgttaatgtacatcttaaattagagagtttgctgaaagaaaattttacaataatgaccatgcaacaacaagcaagaatcatcgtttggcagagaaaagctgtttgtgctatctactcaaacctctttgtagaagttaaacgtagattgaaagaagtgttgcacagaaaaattgtatatgcagatggactacgaccagatgaaatatcagctagggtaaggttagtcaagaatgtagctggattctttgaaaatgatttaactaaacaagatagacaaactgataaacctatcattgaagtagaattgatgatatatgatttattgggagttcatccaaacgtaatagcatcttggaaagaaatgcatgaggtgtggagatttaagtcgaatttgtactggggtcaaggagaaggtatgcggttgactggacaggcaacgactgcacttggcaattgtttgaccaatcttcaagtacaccaaaactttacaaagacaaatttccgtatattgcaactagggttatttttaggggatgatatgtgtatggtgttcagtgagaagccagatacgtcaaacctcagaaaagatattgcaaccagcttcaacatg

SEQ ID NO: 525 - DNA, 711 bp, Phaseolus vulgaris alphaendornavirus 1
  source 1..711: mol_type = other DNA
gatgttgaacaatggattgatgataacaaggactgcccaaagattgttaaggaactgttacagttgttatctggtgagttgtgtgtcaagcacataagtaatgtcaatgtacatcttaagttggaatcattgttgaaagataatcccatagattattggagacaacagcaggcacgtataattgtctggcaacgtaaggctgtatgcgcagtgtatactagcgtattcgtggaggcaaaaagacggttgaaagctattttgcatgacaaaattgtgtatgctgatggcttgcggccagatgagttatcagcacgattaagattatgcaattctgtagctgggttctttgagaatgatttaaccaaacaagaccgacaaacggacaaaccaattatagacgctgagatgataatttatgatatgttaggagtacacgcaaatgtaatcgcttcatggagagaaatgcatgaaacatggatgttcaaatcagataactattggggcacaggccaagccatgcgattaacgggacaagcaacaactgccattgggaatgtattgactaacatgcaagtgcacgccaagttcatacacaaacactggaatattttggaagttggtctattcttgggagatgatatgtgtctagtgttcaaacataaaccttcttaccaccatttgaagaacgacatcgcaaccatgtttaatatg

SEQ ID NO: 526 - DNA, 711 bp, Phaseolus vulgaris alphaendornavirus 2
  source 1..711: mol_type = other DNA
aaagtgctagattggttaagagaccgtccggacagtaataaaatagcagaagaactgaacaatattttagctgagggtatgcaactgcacccaatcaacaaattaaacgtgcacttgaaattggagtcgttgttgaaatcagagccagcgtcaaatttaaaacaagtcaaggctagagctttggtttggcagtgtaaaggatattgcgccatatttagtcacgtgttcaaagaagttaaagttagactcaaagatttgttgcgaccagaaattgtgtattcagatggcttaagggcggatgaattggctgcaagagtgaggttgaccacaaatgtcaaatttttgctggaaaatgacttggcccaacaagacaaacaaaccgatcatgagataatcaaggttgaaatggaaatttataaattgttaggcgtgtgccctcacctagtggatttatggaaaaattgtcaccacagttgggtatacaagtctagaactgtagcaggtgtaggtgacgctatgcgactcactggccaagccaccactgctatagggaacgccatcaccaatatgctggtacataggcggttggttaaaacattgggtcacaacctaagattgtttttggtgttgggtgatgatggattaatgttcacaacaacatgggtggataccactaagttgaataacgagctgaaaaccaatcataacatg

SEQ ID NO: 527 - DNA, 711 bp, Bell pepper alphaendornavirus
  source 1..711: mol_type = other DNA
aaagtgctggactggttgagagataggcctgacagtaacaaagtggcagcagaattagaagtgatactagaagagggaatgcaattacatgccattaacaagctaaacgtgcacctgaaattggaatcgttattaaagtctgagccagcaagtagtttgaaacaagtaaaagctagagcgttgttgtggcaatgcaaagggtattgtgcaatatttagtcacatttttaaagaggcaaaagtgagacttaagcaaatgttaaaacccaatatagtttatgctgacgggttgagggcagacgagctatccgcaagagtgagactgactacaggtgtaaaatatttattagaaaacgatttggcacaacaagacaaacaaactgaccatgaaataattaaatttgaaatggcactgtacaaagtgctaggggtgcatgacgatgtgataaccttgtggcacaacagtcattttaactggaaatacaagtccaggacagtgcgaggagagggagatgccatgagattgactggtcaagcaactacagctctggggaatgccataaccaacatgttggtgcatagaagattagttaatcgactcgggcacaatttgcgattgtttctgattttaggagatgacggtctcatgtttactaacacaagtatagatcttagccgattaaacaatgaaaccaaaatcaaacacaacatg

SEQ ID NO: 528 - DNA, 711 bp, Bell pepper alphaendornavirus
  source 1..711: mol_type = other DNA
aaagtgttggattggttgagagacagacctgatagtaataaggtagcagtagaactagaagtgatattggaagagggaatgcaactacatgccattaacaggctaaatgtgcacctaaaattggaatcattgttaaaagctgaaccagcaagtagtttaaaacaagtgaaagctagagcgttgttatggcagtgtaaaggttactgtgcaatttttagtcacattttcaaagaggcgaaagtgagactcaarcaaatgttaaaaccaaacattgtttatgctgacggattgagagcagatgagttgtccgcaagagtaagactaaccacaggtgtaaaatatttattagaaaatgacttagcacagcaagacaaacaaactgaccatgaaataattaaatttgaaatggcactgtacaaactgttaggggtgcatgacgatgttataaccttgtggcacaacagtcatttcaattggaaatacaaatccaggacagtaagaggagagggagatgccatgagattgactggtcaagcaactacagctctgggaaatgctataaccaatatgttggtgcatagacgattagttaaccggctcggacataatctaagattgtttttaattttaggagatgatggtctcatgtttaccaatacgagcatagatctcagtcgactaaacaatgagacaaagatcaaacacaatatg

SEQ ID NO: 529 - DNA, 711 bp, Bell pepper alphaendornavirus
  source 1..711: mol_type = other DNA
aaagtgttggattggttgagagacagacctgatagtaataaggtagcagyagaactagaagtgatattggaagagggaatgcaaytacaygcyattaacaggctaaatgtgcacctraaattrgaatcattgttaaargctgaaccagcaagtagtttaaaacaagtgaaagcwagagcgttgttatggcagtgtaaaggttactgtgcaatttttagtcacattttyaaagaggcgaaagtragactcaagcaaatgttaaraccaaayatwgtytatgctgacggattgagagcagatgagttgtccgcaagagtaagactaaccacaggtgtraaatatttrttagaaaatgayttagcacagcaagacaaacaaactgaccatgaaataattaaatttgaaatggcactgtacaaactgttaggggtgcatgacgatgtwataaccttgtggcacaacagtcatttcaattggaaatacaaatcyagracrgtaagaggwgarggagatgccatgagattgactggkcargcaactacagctytgggraatgcyataacyaatatgttggtgcatagacgattrgttaaycggctcggacayaatytaagattgtttttaattttaggagatgatggtctcatgtttaccaatacgagcatagayctcagccgactaaayaatgagacaaagatcaaacacaayatg

SEQ ID NO: 530 - DNA, 711 bp, Bell pepper alphaendornavirus; identical to SEQ ID NO: 494
  source 1..711: mol_type = other DNA

SEQ ID NO: 531 - DNA, 813 bp, Oryza sativa alphaendornavirus
  source 1..813: mol_type = other DNA
gatgtcaaaattggatcgaagaaaataaagattgtttggtgctgaaaagagttaaatgatttactagcaggcgaattattaatcaatcttaaatgatgttaatgttcatttaaagttggagtttctaaaggacaaacatatctccattatgaaggaacagcaagctagaataatagtatagcaaaggaaagcagttgtagtctatttgccaaattgtttaagatgcaaagacagactgaaaactttactgatagatatcgttactctacgtggatggatcagaccagatgaaatatcagccaattaagacaaatatctgatgtatttggattttgaaaacgacctgactaagcaagatagacaaactgacaaaccaattttggaagtggaaatgttgatgtatctcatgttgagttcatcctaacatcatatcagttggtgctctcaagtcatgatgattggagattcaaatcgatcacaaattattgggtaagagcacactcaacagcaatgagattatagggacaagccacaactgcactaggggaaattgtattactaatatgcaagtacacatcaaaatttgtaatcaaaataattggttagttttcttgctttatctaggacgatatgtgtatgggtttttcaccaagccaatgcacatcatcacgccaggatatagcttgtaaatttaatgcaaaagcaaagattttcttggatgactaatggagcaacgttctctgtagcatggtggtttacaaaacgaatgataacgtaagaattgggccagatgtagtcaggatgaaatttagg

SEQ ID NO: 532 - DNA, 906 bp, unidentified
  source 1..906: mol_type = other DNA; note = unclassified Endornaviridae
gtgtgcaatgcatactttaaacccggatgggagcacaatataccgcattttaaaaatgatttattaatcataactcccgaagatgtcaaaaattggatcgaagaaaataaagattgttttggtgttgaaaaagagttaaatgatttactagcaggcgaattattaatcaaaccattaaatgatgttaatgttcatttaaagttggagtctttactaaaggacaaacatatctccattatgaaggaacagcaagctagaataatagtatggcaaaggaaagcagtttgtagtttatttgccaaattgtttgtaagatgcaaagacagactgaaaactttactgatagatcatatactttacgtggatggattgagaccagatgaaatatcagccaaattaagacaaatatctgatgtatttggattctttgaaaacgacctgactaagcaagatagacaaactgacaaaccaattttggaagtggaaatgttgatgtatcttatgttgggagttcaccctaacatcatatccagttggcgttcaagtcatgatgattggagattcaaatctacaaattattggggtaagagcacagcaatgagattaacgggacaagccacaactgcactaggaaattgtattactaatatgcaagtacactcaaaatttgtaatcaaaaataaatattggttaaagtttgctttatttcttggggacgatatgtgtatgggtttttcacacaagccaaatacacaacacttacgccaggatatagcttgtaaatttaatatgcaaagtaaagattcttggatgactaatggagcaacgttctgtagcatggtagtttacaaaacgaatgataacgtagtagaattgggcccagatgtagtcaggatgaaatttagg

SEQ ID NO: 533 - DNA, 993 bp, unidentified
  source 1..993: mol_type = other DNA; note = unclassified Endornaviridae
accggtagactgttttcagttgtcaaccttcgtacagttacgcctgaccctgagagaatactttgggatgtgtgcaatgcatatttcaaacctggttgggagctaaatataccgcattttaaaaatgatttattgattataactcctaaagatgtcaaagattggatcgaagagaataaagattgctttggtgttgaaaaagagctaaatgatttgctagcaggtgaattattgattaaaccgttaaatgatgtaaatgttcatctgaaattagagtccttactaaaagacaaacatatctccatgatgaaggaacaacaagctaggataatagtatggcaaagaaaagctgtttgtagtttatttgccaaattgtttgtgaaatgtaaagatagactaaaatctttacttatggatcatatactttacgtcgatggactgagaccagacgaaatctccgctaaattaaggcagatatctgatgtattcggattctttgaaaacgacttgacaaagcaagatagacaaactgataagcccattttagaagtggaaatgttgatgtatctaatgctaggagttcatcccaacgttatatccagttggcgttcaagtcatgatgattggagatttaaatccacaaactattggggtaaaagtactgcaatgagattaactggacaagctacaactgccctaggaaattgtatcacaaacatgcaagtgcactcaaaatttgtaatcaaaaataaatattggttaaaatttgctttgttccttggagatgatatgtgtatgggcttctcacacaaaccaaatacacaacacttacgtcaggatatagcttgtaaatttaacatgcagagcaaagattcttggatgaccaatggggcaacgttttgtagtatggtggtttacaaaacaaatgataatgtagtggaattaggtccagatgtggtcaggatgaaatttagatatgaagttaccaatggt

SEQ ID NO: 534 - protein, 237 aa, Bell pepper alphaendornavirus
KVLDWLRDRPDSNKVAAELEVILEEGMQLHAINRLNVHLKLESLLKAEPASSLKQVKARALLWQCKGYCAIFSHIFKEAKVRLKQMLKPNIVYADGLRADELSARVRLTTGVKYLLENDLAQQDKQTDHEIIKFEMALYKLLGVHDDVITLWHNSHFNWKYKSRTVRGEGDAMRLTGQATTALGNAITNMLVHRRLVNRLGHNLRLFLILGDDGLMFTNTSIDLSRLNNETKIKHNM

SEQ ID NO: 535 - protein, 237 aa, Cucumis melo alphaendornavirus
DVKKWIEENKDCEKIERELIDLLCGELISKPINDVNVHLKLESLLKENFTIMTMQQQARIIVWQRKAVCAIYSNLFVEVKRRLKEVLHRKIVYADGLRPDEISARVRLVKNVAGFFENDLTKQDRQTDKPIIEVELMIYDLLGVHPNVIASWKEMHEVWRFKSNLYWGQGEGMRLTGQATTALGNCLTNLQVHQNFTKTNFCILQLGLFLGDDMCMVFSEKPDTSNLRKDIATSFNM

SEQ ID NO: 536 - protein, 237 aa, Bell pepper alphaendornavirus
KVLDWLRDRPDSNKVAVELEVILEEGMQLHAINRLNVHLKLESLLKAEPASSLKQVKARALLWQCKGYCAIFSHIFKEAKVRLKQMLKPNIVYADGLRADELSARVRLTTGVKYLLENDLAQQDKQTDHEIIKFEMALYKLLGVHDDVITLWHNSHFNWKYKSRTVRGEGDAMRLTGQATTALGNAITNMLVHRRLVNRLGHNLRLFLILGDDGLMFTNTSIDLSRLNNETKIKHNM

SEQ ID NO: 537 - protein, 237 aa, Bell pepper alphaendornavirus; identical to SEQ ID NO: 534

SEQ ID NO: 538 - protein, 237 aa, Bell pepper alphaendornavirus
KVLDWLRDRPDSNKVAAELEVILEEGMQLHAINKLNVHLKLESLLKSEPASSLKQVKARALLWQCKGYCAIFSHIFKEAKVRLKQMLKPNIVYADGLRADELSARVRLTTGVKYLLENDLAQQDKQTDHEIIKFEMALYKVLGVHDDVITLWHNSHFNWKYKSRTVRGEGDAMRLTGQATTALGNAITNMLVHRRLVNRLGHNLRLFLILGDDGLMFTNTSIDLSRLNNETKIKHNM

SEQ ID NO: 539 - protein, 237 aa, Bell pepper alphaendornavirus; identical to SEQ ID NO: 536

SEQ ID NO: 540 - protein, 237 aa, Persea americana alphaendornavirus 1
DVRAWIEDSKDSNKIVKELKELLAGEMLIKPMNDVNVHLKLESLLKANPINVTKEQQARVIVWQRKCVCALYARLFLKIKSRLKEILHEKIVYADGLTPDDISARVRLCNNVNGFFENDLTKQDRQTDRDIINMEMLVYIVLGANPSIISSWREMHEVWRFKSANYWGEGKEMRLSGQATTALGNVITNLQVHCKFVKKNSISMQLGLFLGDDMCMLFSEKPSIKNLRNDIACEFNM

SEQ ID NO: 541 - protein, 237 aa, Bell pepper alphaendornavirus
KVLDWLRDRPDSNKVAVELEVILEEGMQLHAINRLNVHLKLESLLKAEPASSLKQVKARALLWQCKGYCAIFSHIFKEAKVRLKQMLKPNIVYADGLRADELSARVRLTTGVKYLLENDLAQQDKQTDHEIIKFEMALYKLLGVHDDVITLWHNSHFNWKYKSRTVGGEGDAMRLTGQATTALGNAITNMLVHRRLVNRLGHNLRLFLILGDDGLMFTNTSIDLSRLNNETKIKHNM

SEQ ID NO: 542 - protein, 237 aa, Oryza sativa alphaendornavirus
DVKNWIEENKDCFGVEKELNDLLAGELLIKPLNDVNVHLKLESLLKDKHISIMKEQQARIIVWQRKAVCSLFAKLFVRCKDRLKTLLVDHILYVDGLRPDEISAKLRQISDVFGFFENDLTKQDRQTDKPILEVEMLMYLMLGVHPNIISSWRSSHDDWRFKSTNYWGKSTAMRLTGQATTALGNCITNMQVHSKFVIKNKYWLKFALFLGDDMCMGFSHKPNTQHLRQDIACKFNM

SEQ ID NO: 543 - protein, 237 aa, Oryza rufipogon alphaendornavirus
DVKNWVEENKDCFGVEKELNDLLAGELLIKPINDVNVHLKLESLLKEKHISLMKEQQARIIVWQRKAVCGLFAKLFVRCKERLKTLLLDHILYVDGLRPDEISAKLRQISNVFGFFENDLTKQDRQTDKPILEVEMLMYLMLGVHPNIIASWRASHEDWRFKSTNYWGKSTAMRLTGQATTALGNCITNMQVHSKFVIKNKYWLKFALFLGDDMCMGFSHKPNTQHLRQDIACKFNM

SEQ ID NO: 544 - protein, 237 aa, unidentified
  source 1..237: note = unclassified Endornaviridae
DVKNWIEQNKDCEKIEKELIDLLCGELITKPINDVNVHLKLESLLKENFTIMTMQQQARIIVWQRKAVCAIYSNLFVEVKRRLKEVLHRKIVYADGLRPDEISARVRLVKNVAGFFENDLTKQDRQTDKPIIEVELMLYDLLGVHPNVIASWKEMHEVWRFKSNLYWGQGEGMRLTGQATTALGNCITNLQVHQKFTKTNFQTLQLGLFLGDDMCMIFSEKPDTSNLRKDIAAEFNM

SEQ ID NO: 545 - protein, 237 aa, Bell pepper alphaendornavirus
KVLDWLRDRPDSNKVAVELEVILEEGMQLHAINRLNVHLKLESLLKAEPASSLKQVKARALLWQCKGYCAIFSHIFKEAKVRLKQMLKPNIVYADGLRADELSARVRLTTGVKYLLENDLAQQDKQTDHEIIKFEMALYKLLGVHDDVITLWHNSHFNWKYKSRTVRGEGDAMRLTGQATTALGNAITNMLVHRRLVNRLGHNLRLFLILGGDGLMFTNTSIDLSRLNNETKIKHNM

SEQ ID NO: 546 - protein, 238 aa, unidentified
  source 1..238: note = unclassified Endornaviridae
EIRTWLAARPDGLQVAAELEAIMAEGFEVNPINRAKVHVKLESLLKDGYDSVGNREVEARIIVWQRKGFCAIFSPIFLQAKSRLKSLLNDKTLYADGLTAGELSARARLLPGGLWMMEDDLSKQDRQTDRNLIECEMECYKQLGVDERVLRFWERTHQNWKFKGSSVSGILDAQRLTGQATTALGNALVNMMVHSRLVEENKRHVRLVCILGDDNLILSEHKISSWRQVKDSKDYYNM

SEQ ID NO: 547 - protein, 237 aa, unidentified
  source 1..237: note = unclassified Endornaviridae
KVLDWLRDRPDSNKVAEEVETILQEGMQLHSINRLNVHLKLESLLKAEPASSLKQVKARALLWQCKGYCAIFSHIFKEAKARLKQLLKPTIVYADGLRADELSARVRLTTNVHYLMENDLAQQDKQTDHDIIKFEMELYRLLGVHDDVINLWHSSHFHWKYKSRTVKGAGDAMRLTGQATTALGNAITNLLVHRKVVDRLGSSLRLFLVLGDDGLMFTSEKIDLSKLNNETKIKHNM

SEQ ID NO: 548 - protein, 237 aa, Cucumis melo alphaendornavirus; identical to SEQ ID NO: 535

SEQ ID NO: 549 - protein, 237 aa, Bell pepper alphaendornavirus; identical to SEQ ID NO: 536

SEQ ID NO: 550 - protein, 237 aa, unidentified
  source 1..237: note = unclassified Endornaviridae
KVLDWLRDRPDSNKVAEEVETILQEGMQLHSINRLNVHLKLESLLKAEPASSLKQVKARALLWQCKGYCAIFSHIFKEAKARLKQLLKPTIVYADGLRADELSARVRLTTNVRYLMENDLAQQDKQTDHDIIKFEMELYRLLGVHDDVINLWHNSHFHWKYKSRTVKGAGDAMRLTGQATTALGNAITNLLVHRKVVDKLGSSLRLFLVLGDDGLMFTSEKIDLSKLNNETKIKHNM

SEQ ID NO: 551 - protein, 237 aa, unidentified; identical to SEQ ID NO: 550
  source 1..237: note = unclassified Endornaviridae

SEQ ID NO: 552 - protein, 237 aa, unidentified
  source 1..237: note = unclassified Endornaviridae
KVLDWLSQRPDGNKIAAELEGILSSGMEVNPINNINVHLKLESLLKEEPAKSIKQVKARPLMWQCKGYCAVFSHCFKEVKQRLKQLLKHNIVYTDGLRADELAARVRAAGDFKYIFENDLAQQDKQTDMEIIEFEMYLYKKLGMNPGMVNLWKNCHRHWKYKSRTVMGVRDAMRLTGQATTALGNVITNMLVHRRITQQLQDSLRLFLLLGDDGLMLLDSWINVDHLNTELKHHHNM

SEQ ID NO: 553 - protein, 235 aa, unidentified
  source 1..235: note = unclassified Endornaviridae
QAWIDKHNMPASVKRDIREMLEMGWEQRPINSMEVHGKTEQTTKLKNARWFNEVVTRSIVAAPYAVSALFAEVFMEMKQRFKSVLRSDVFYSDGSTPAELAALVRQCGEFKYCTEDDLTQQDGQTDRQIINIEMEIYKMLGLSGNVLAFYRQCHDNWKWKGHGISGVWDAMRLSGQVTTALGNAITNLIVHNRFMLRNRNSIKKVLFLGDDIIFLSNTKLKVANHGTETKELYNM

SEQ ID NO: 554 - protein, 237 aa, Bell pepper alphaendornavirus; identical to SEQ ID NO: 536

SEQ ID NO: 555 - protein, 239 aa, unidentified
  source 1..239: note = unclassified Endornaviridae
AIKAWLTSRPDAVKIAAEVDAIMVEGFETNQLNTIKVHLKLESLLKENPVKYMKQLQPRIIAWQSKGICALYSHCFKNIKQRFKSMLKQNVIYTDGMTPDNLGERCRNVQIKPTYNFVENDLTKQDRQTDHNLIDFEMAIYIKLGADKNLIESWLRVHKNWRARGTYIVMHGDAMRLTGQATTALGNAIVNLICHMDLVERLSTRLILMLILGDDNAFLVDGEIDTVTLRRWIADKCNM

SEQ ID NO: 556 - protein, 237 aa, unidentified
  source 1..237: note = unclassified Endornaviridae
KTKQWIAKHHNASKVLKDLETFLVEGNQIRSIADINIHLKLESLLKDPAIQSFKQQQPRSIMWQHYYVAAIYSPIFMEVKKRLKFLLKEHIIYADGYKASDLSKVLSTIRAGKYYYESDLKKQDRQTDKPLLDVEMEIYRLLGVDDKVLNSWRTVHEKWRFKGTYSKGLCQEMRTTGQATTAIGNVITNMQANLPVIEKYGATIKLMMMLGDDNLMNMEVLVNTKEAEKNIAVTCNM

SEQ ID NO: 557 - protein, 237 aa, Bell pepper alphaendornavirus
KVLDWLRDRPDSNKVAAELEVILEEGMQLHAINRLNVHLKLESLLKAEPASSLKQVKARALLWQCKGYCAIFSHIFKEAKVRLKQMLKPNIVYADGLRADELSARVRLTTGVKYLLENDLAQQDKQTDHEIIKFEMALYKLLGVHDDVITLWHNSHFNWKYKSRTVRGEGDAMRLTGQATTALGNAITNMLVHRRLVNRLGYNLRLFLILGDDGLMFTNTSIDLSRLNNETKIKHNM

SEQ ID NO: 558 - protein, 238 aa, unidentified
  source 1..238: note = unclassified Endornaviridae
DFRNWIYGHKNAHKVITELESLSAEGPLVNPFNFFRSHVKLESINKENPIMDFRQAAPRAIVWLPYCMPALFSYMFKMASNRFKLILRKEVHYASGLDVNDIEQIVRNTDDSDVFFFDNDISKMDSQIDKDLIEVEWEVLSLMGISPDVLESYKTLKRNWRISNKYISVTGKWLRHSGEPTTALGNGIINLAITALSTTETRRQDLKLCLFMGDDMVMLTKKKEDVLQVKKKGKHLAN

SEQ ID NO: 559 - protein, 237 aa, Phaseolus vulgaris alphaendornavirus 2
KVLDWLRDRPDSNKIAEELNNILAEGMQLHPINKLNVHLKLESLLKSEPASNLKQVKARALVWQCKGYCAIFSHVFKEVKVRLKDLLRPEIVYSDGLRADELAARVRLTTNVKFLLENDLAQQDKQTDHEIIKVEMEIYKLLGVCPHLVDLWKNCHHSWAYKSRTVAGVGDAMRLTGQATTAIGNAITNMLVHRRLVKTLGHNLRLFLVLGDDGLMFTTTWVDTTKLNNELKTNHNM

SEQ ID NO: 560 - protein, 237 aa, Basella alba alphaendornavirus 1
DVENWIKANKDCPKIVTEMLETLSGGFLNKHINDVNVHLKLESLYKPDPINVWRQQQARIIVWQRKSICAIYSSAFKAIKNNLKACLDYKVVYADGLRPDELSARARLCNNVAGFFENDLTKQDRQTDRPLLEVEMMLYDILGLHPKVISSWKEMHEEWRFKSEHYWGTGTSMRLTGQATTAIGNCITNLQVHQQFVKDNWDNLELALFLGDDMCMVFSQQPSIKDLKYDIAVNYNM

SEQ ID NO: 561 - protein, 237 aa, unidentified
  source 1..237: note = unclassified Endornaviridae
DVKKWIEENKDCEKIERELIDLLCGELISKPINDVNVHLKLESLLKENFTIMTMQQQARIIVWQRKAVCAIYSNLFVEVKRRLKEVLHRKIVYADGLRPDEISARVRLVKNVAGFFENDLTKQDRQTDKPIIEVELMIYDLLGVHPNVIASWKEMHEVWRFKSNLYWGQGEGMRLTGQATTALGNCLTNLQVHQNFTKTNFRILQLGLFLGDDMCMVFSEKPDTSNLRKDIATNFNM

SEQ ID NO: 562 - protein, 237 aa, Oryza sativa alphaendornavirus; identical to SEQ ID NO: 542

SEQ ID NO: 563 - protein, 237 aa, Oryza sativa alphaendornavirus; identical to SEQ ID NO: 542

SEQ ID NO: 564 - protein, 237 aa, unidentified
  source 1..237: note = unclassified Endornaviridae
AVLDWIKSRPDNNAIAEETERILMEGMHVNPINMVNVHLKLESLLKEEPATNLKQVKPRALVWQCKGYCAMFSHAFKQIKNRLKMVLNEKVVYADGLQADEVSNRLRLVVGDLWVLENDLAQQDRQTDHEILNFEMELYLKLGMLPLMVRIWRNVHNNWRYKSKTVSGMRDGMRLTGQATTALGNVITNLLVHRQLVQKLGNAVKLFLVLGDDGIMLTSVKPDTDRLRQYCKHYHNM

SEQ ID NO: 565 - protein, 237 aa, Bell pepper alphaendornavirus
KVLDWLRDRPDSNKVAAELEVILEEGMQLHAINRLNVHLKLESLLKSEPASSLKQVKARALLWQCKGYCAIFSHIFKEAKVRLKQMLKPNIVYADGLRADELSARVRLTTGVKYLLENDLAQQDKQTDHEIIKFEMALYKVLGVHDDVITLWHNSHFNWKYKSRTVRGEGDAMRLTGQATTALGNAITNMLVHRRLVNRLGHNLRLFLILGDDGLMFTNTSIDLSRLNNETKIKHNM

SEQ ID NO: 566 - protein, 237 aa, unidentified
  source 1..237: note = unclassified Endornaviridae
KVLDWLRERPDSNKIADELEMILSSGLEVNPINNIKVHLKLESLLKEVPAESIKQVKARPLMWQTKGYCALFSHIFKEVKIRLKNMLKANIVYSDGLRADELAARVRQVSDANWLLENDLAQQDKQTDHQIIAFEMALYKELGVDAGVVNLWHRCHFHWKYKAATVMGIRDAMRLTGQATTAIGNAITNMLVHRKLAQQAGNNLKLFLILGDDGLMFTEEMVDVHKLNAEMKTKHNM

SEQ ID NO: 567 - protein, 237 aa, Hordeum vulgare alphaendornavirus
KVKEWLQGRPNVESIVGEVNNILTEGFMKHPINKLNVHLKLESLLKSQPVVDHRQTKARILVWQAKGMCAIYSPVFKMAKDRLKSLLNTKTVYADGLRPDQLALRVTQADPANYIMENDLEQQDRQTDDKLLDVEMAIYHMLGVQEELLSLWRQCHNNWNFKGRSCRGERNWMRLTGQATTALGNAITNLCVHWRLCSKLGNDWKLFVLLGDDGALLTNRTLSNKEVKTHGKLLYNM

SEQ ID NO: 568 - protein, 237 aa, Hordeum vulgare alphaendornavirus; identical to SEQ ID NO: 567

SEQ ID NO: 569 - protein, 237 aa, Cucumis melo alphaendornavirus
DVKKWIEENKDCEKIERELIDLLCGELISKPINDVNVHLKLESLLKENFTIMTMQQQARIIVWQRKAVCAIYSNLFVEVKRRLKEVLHRKIVYADGLRPDEISARVRLVKNVAGFFENDLTKQDRQTDKPIIEVELMIYDLLGVHPNVIASWKEMHEVWRFKSNLYWGQGEGMRLTGQATTALGNCLTNLQVHQNFTKTNFRILQLGLFLGDDMCMVFSEKPDTSNLRKDIATSFNM

SEQ ID NO: 570 - protein, 237 aa, Phaseolus vulgaris alphaendornavirus 1
DVEQWIDDNKDCPKIVKELLQLLSGELCVKHISNVNVHLKLESLLKDNPIDYWRQQQARIIVWQRKAVCAVYTSVFVEAKRRLKAILHDKIVYADGLRPDELSARLRLCNSVAGFFENDLTKQDRQTDKPIIDAEMIIYDMLGVHANVIASWREMHETWMFKSDNYWGTGQAMRLTGQATTAIGNVLTNMQVHAKFIHKHWNILEVGLFLGDDMCLVFKHKPSYHHLKNDIATMFNM

SEQ ID NO: 571 - protein, 237 aa, Phaseolus vulgaris alphaendornavirus 2
KVLDWLRDRPDSNKIAEELNNILAEGMQLHPINKLNVHLKLESLLKSEPASNLKQVKARALVWQCKGYCAIFSHVFKEVKVRLKDLLRPEIVYSDGLRADELAARVRLTTNVKFLLENDLAQQDKQTDHEIIKVEMEIYKLLGVCPHLVDLWKNCHHSWVYKSRTVAGVGDAMRLTGQATTAIGNAITNMLVHRRLVKTLGHNLRLFLVLGDDGLMFTTTWVDTTKLNNELKTNHNM

SEQ ID NO: 572 - protein, 237 aa, Bell pepper alphaendornavirus; identical to SEQ ID NO: 538

SEQ ID NO: 573 - protein, 237 aa, Bell pepper alphaendornavirus; identical to SEQ ID NO: 536

SEQ ID NO: 574 - protein, 237 aa, Bell pepper alphaendornavirus
KVLDWLRDRPDSNKVAXELEVILEEGMQLHAINRLNVHLKLESLLKAEPASSLKQVKARALLWQCKGYCAIFSHIFKEAKVRLKQMLXPNIVYADGLRADELSARVRLTTGVKYLLENDLAQQDKQTDHEIIKFEMALYKLLGVHDDVITLWHNSHFNWKYKSRTVRGEGDAMRLTGQATTALGNAITNMLVHRRLVNRLGHNLRLFLILGDDGLMFTNTSIDLSRLNNETKIKHNM

SEQ ID NO: 575 - protein, 237 aa, Bell pepper alphaendornavirus; identical to SEQ ID NO: 536

SEQ ID NO: 576 - protein, 465 aa, unidentified
  source 1..465: note = unclassified Endornaviridae
PYTMNYTASVIEPLFDMPDIASMQLWTDTDLTDWLNMYAPSNKTVIKSRELPGKIINMEKITMTKYPIKSRPVLTKICFEEGRSITGRLFSVVNLRTVTPDPEKILWDVCNAYFKPGWEHNIPHFKNDLLIITPEDVKNWIEENKDCFGVEKELNDLLAGELLIKPLNDVNVHLKLESLLKDKHISIMKEQQARIIVWQRKAVCSLFAKLFVRCKDRLKTLLIDHILYVDGLRPDEISAKLRQISDVFGFFENDLTKQDRQTDKPILEVEMLMYLMLGVHPNIISSWRSSHDDWRFKSTNYWGKSTAMRLTGQATTALGNCITNMQVHSKFVIKNKYWLKFALFLGDDMCMGFSHKPNTQHLRQDIACKFNMQSKDSWMTNGATFCSMVVYKTNDNVVELGPDVVRMKFRYEVTNGVHEATKENLLMRKASYLMMLGKTPEVDKLVNDLQLPINPVHWYNYHTML

SEQ ID NO: 577 - protein, 462 aa, unidentified
  source 1..462: note = unclassified Endornaviridae
PYTMNYTASVIEPLFDMPDIATMQLWTDTDLTDWLNMYAPSNKTVIKSRELPGKIINMEKITMTKYPIKSRPVLTKICFEEGRSITGRLFSVVNLRTVTPDPERILWDVCNAYFKPGWELNIPHFKNDLLIITPKDVKDWIEENKDCFGVEKELNDLLAGELLIKPLNDVNVHLKLESLLKDKHISMMKEQQARIIVWQRKAVCSLFAKLFVKCKDRLKSLLMDHILYVDGLRPDEISAKLRQISDVFGFFENDLTKQDRQTDKPILEVEMLMYLMLGVHPNVISSWRSSHDDWRFKSTNYWGKSTAMRLTGQATTALGNCITNMQVHSKFVIKNKYWLKFALFLGDDMCMGFSHKPNTQHLRQDIACKFNMQSKDSWMTNGATFCSMVVYKTNDNVVELGPDVVRMKFRYEVTNGVHEATKENLLMRKASYLMMLGKTPEVDKLVKDLKLPINPVHWYNYH

SEQ ID NO: 578 - RNA, 1912 nt, synthetic construct
  source 1..1912: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgagtgtgcggaagaacttgaaggtttgctacacagtcaaatatgtactgcagaagatcccagcttgctgcagtactcaatcaaaggtaaacctgagactcttgcctactatgatcccttgggcccgaaattcaatactcctctttatcttcaaatgctcccgcttctaaaagacaatcctatctttcggaagccatttgtatttgggacagaagccagtagaactctaggatcttggtgtgttgaccagatctggacggatgccatttgctgcacgccaaaaatacatcgagcagatcttcgccttcgagtaaagctaccacttctatctattatctactataccccagagtcaaatatcatcgtgacgaaaactgtggcgagcctgagaaagattgtgcaaagtctcaacattttcgaagacccctacgttttgacactaaaaaggagtgatagcgaaaaaagtcaacgtgagctggcgaaagtactcaagagtaaataaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 579 - RNA, 2000 nt, synthetic construct
  source 1..2000: mol_type = other RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtgtagcttatttgggttctttatcactgtcctgattaaggctgaatcagaacaccatcacttccactcacacgacagtagtaagacacagaacatagtagttaatactggaaagtaacccaccatgggtgtccaaaagaccgaaacccaggccatttccccagtcccggcagaaaagctgttcaagggttctttccttgacatggacaccgtcgtccccaaggcttttccagaaggtattaagagcgtccaagttcttgagggcaacggcggagttggaaccatcaaaaacgtcactctaggggatgccaccccattcaacaccatgaagacccggatagatgcaattgacgagcatgcattcacttacacttacaccattataggaggtgatatccttttggacattattgaatccatagagaatcatttcaagattgtgcctactgatggagggagcaccatcacacagaccaccatatacaacaccataggtgatgccgtaattccagaagagaatatcaaggatgccaccgataagtcaatccaactattcaaggctgttgaagcttacctcctagcaaattagaaatagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccgccaccatggctctagttgttaaaggaaaagtgaatatcaatgagtttatcgacctgacaaaaatggagaagatcttaccgtcgatgtttacccctgtaaagagtgttatgtgttccaaagttgataaaataatggttcatgagaatgagtcattgtcagaggtgaaccttcttaaaggagttaagcttattgatagtggatacgtctgtttagccggtttggtcgtcacgggcgagtggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtaatgatcggtcagtgccgaacaagaactatagaaatgttaaggattttggaggaatgagttttaaaaagaataatttaatcgatgatgattcggaggctactgtcgccgaatcggattcgttttaaagacgcatccatggctgaatggttaaagcgcccaactcataattggcgaattcgtaggttcaattcctactggatgcaaagatccgtcctactggtgcctaatccgccgtatgttaagagaaaggcagtactttaagcacgaagtgcttcactggtttgaaggaatttaaagccaggttaacaacaaaatttgagttttcggggagggagggcccccccccccc

SEQ ID NO: 580 - RNA, 226 nt, Bell pepper alphaendornavirus
  source 1..226: mol_type = genomic RNA
gtaaaacaaacaaggttttatgactactaagttgtctagaccttttgctttacgtttactgggtggctctcgccccccgaaaactcaaattcttcatgggtgtactggtaacagtatacccatgaagaaattaaataagaaaaacgattgctctgctagaaaagcatttaggcagagcaaatttaaatttaaaataagtaaaaataagacgatatgtccggcagtg

SEQ ID NO: 581 - RNA, 101 nt, Bell pepper alphaendornavirus
  source 1..101: mol_type = genomic RNA
tgttaagagaaaggcagtactttaagcacgaagtgcttcactggtttgaaggaatttaaagccaggttaacaacaaaatttgagttttcggggagggaggg

What is claimed:

1. A method of increasing a plant's resistance and/or tolerance to a fungal pathogen, comprising introducing into a plant a recombinant RNA molecule comprising, in 5' to 3' order: (a) a bell pepper endornavirus (BPEV) 5' replicase recognition sequence recognized by a BPEV RNA-dependent RNA polymerase (RDRP); (b) a cargo RNA sequence comprising an RNA sequence that forms a double-stranded RNA which suppresses expression of at least one target gene of the fungal pathogen; and (c) a BPEV 3' replicase recognition sequence recognized by the BPEV RDRP; wherein the cargo RNA sequence is heterologous to the BPEV 5' and/or 3' replicase recognition sequences; wherein the plant comprises the BPEV RDRP protein that recognizes the BPEV 5' replicase recognition sequence and BPEV 3' replicase recognition sequence, whereby the BPEV RDRP protein catalyzes synthesis of a synthetic endornaviral satellite RNA from the recombinant RNA molecule; and wherein the synthesis of the synthetic endornaviral satellite RNA comprising the cargo RNA sequence results in an increase in the plant's resistance and/or tolerance to the fungal pathogen relative to the resistance and/or tolerance to the fungal pathogen in a control plant lacking the recombinant RNA molecule.

2. The method of claim 1, wherein the fungal pathogen is a *Botrytis* sp.

3. The method of claim 1, further comprising the step of selfing the plant that comprises the recombinant RNA molecule or sexually crossing it, resulting in a population of $F_1$ seed.

4. The method of claim 3, further comprising the steps of growing the $F_1$ seed to produce a population of $F_1$ plants and selecting an $F_1$ progeny plant that comprises the recombinant RNA molecule from the population of $F_1$ plants.

5. The method of claim 3, further comprising screening or selecting for the presence of the recombinant RNA molecule in the plant, in floral tissue of the plant, in male reproductive tissue of the plant, or in female reproductive tissue of the plant.

6. The method of claim 3, wherein the $F_1$ seed lacks DNA that encodes the recombinant RNA molecule.

7. The method of claim 3, wherein the BPEV RDRP is provided to the $F_1$ seed by a commensal non-pathogenic bell pepper endornavirus endemic in at least one parent plant of the $F_1$ seed.

8. The method of claim 1, wherein the plant is a grafted plant and the recombinant RNA molecule is introduced into the grafted plant by contacting the scion, the rootstock, or both the scion and the rootstock with a composition comprising the recombinant RNA molecule prior to grafting the scion onto the rootstock to produce the grafted plant.

9. The method of claim 1, wherein the recombinant RNA molecule is introduced into the plant by contacting the plant with a formulation including the recombinant RNA molecule.

10. The method of claim 9, wherein the recombinant RNA molecule further comprises an operably linked encapsidation recognition sequence and is encapsidated by a viral coat protein.

11. The method of claim 10, wherein the viral coat protein is a tobamoviral coat protein.

12. The method of claim 1, wherein the RNA sequence that forms the double-stranded RNA which suppresses expression of at least one target fungal gene comprises a hairpin RNA (hpRNA), an RNA that forms multiple stem-loops, an siRNA precursor, or a miRNA precursor.

13. The method of claim 12, wherein the fungal pathogen is *Botrytis*.

14. The method of claim 13, wherein the target fungal gene is DCL1 and/or DCL2.

15. The method of claim 1, wherein the BPEV 5' replicase recognition sequence comprises an RNA molecule having at least 90% sequence identity to the BPEV 5' replicase recognition sequence of SEQ ID NO: 580 and the BPEV 3' replicase recognition sequence comprises an RNA molecule having at least 90% sequence identity to the BPEV 3' replicase recognition sequence of SEQ ID NO: 581.

16. The method of claim 15, wherein the BPEV RDRP is encoded by an RNA molecule with at least 90% sequence identity to the RNA equivalent of the BPEV RDRP coding sequence of SEQ ID NO: 494.

17. The method of claim 1, wherein the BPEV 5' replicase recognition sequence comprises at least 200 nucleotides of SEQ ID NO: 580.

18. The method of claim 1, wherein the BPEV 3' replicase recognition sequence comprises at least 100 nucleotides of SEQ ID NO: 581.

19. The method of claim 1, wherein the plant that comprises the BPEV RDRP and the introduced recombinant RNA molecule lacks DNA that encodes the recombinant RNA molecule.

* * * * *